(12) United States Patent
Silverman et al.

(10) Patent No.: US 10,480,016 B2
(45) Date of Patent: Nov. 19, 2019

(54) GENETICALLY ENGINEERED MICROORGANISMS FOR BIOLOGICAL OXIDATION OF HYDROCARBONS

(71) Applicant: Calysta, Inc., Menlo Park, CA (US)

(72) Inventors: Joshua A. Silverman, Los Altos Hills, CA (US); Drew D. Regitsky, San Francisco, CA (US)

(73) Assignee: Calysta, Inc., Menlo Park, CA (US)

(*) Notice: Subject to any disclaimer, the term of this patent is extended or adjusted under 35 U.S.C. 154(b) by 0 days.

(21) Appl. No.: 14/435,714

(22) PCT Filed: Oct. 15, 2013

(86) PCT No.: PCT/US2013/065087
§ 371 (c)(1),
(2) Date: Apr. 14, 2015

(87) PCT Pub. No.: WO2014/062703
PCT Pub. Date: Apr. 24, 2014

(65) Prior Publication Data
US 2015/0232888 A1    Aug. 20, 2015

Related U.S. Application Data

(60) Provisional application No. 61/714,123, filed on Oct. 15, 2012.

(51) Int. Cl.
| | | |
|---|---|---|
| *C12N 1/21* | (2006.01) | |
| *C12N 9/02* | (2006.01) | |
| *C12N 9/04* | (2006.01) | |
| *C12P 7/04* | (2006.01) | |
| *C12P 7/16* | (2006.01) | |
| *C12P 17/02* | (2006.01) | |

(52) U.S. Cl.
CPC .............. *C12P 7/04* (2013.01); *C12N 9/0071* (2013.01); *C12P 17/02* (2013.01)

(58) Field of Classification Search
None
See application file for complete search history.

(56) References Cited

U.S. PATENT DOCUMENTS

| | | | |
|---|---|---|---|
| 2,793,096 | A | 5/1957 | Pomeroy |
| 3,846,289 | A | 11/1974 | Jeris et al. |
| 4,009,098 | A | 2/1977 | Jeris |
| 4,009,105 | A | 2/1977 | Jeris |
| 4,032,407 | A | 6/1977 | Scott et al. |
| 4,999,302 | A | 3/1991 | Kahler et al. |
| 5,079,168 | A | 1/1992 | Amiot |
| H1430 | H | 4/1995 | Apel et al. |
| 5,585,266 | A | 12/1996 | Plitt et al. |
| 6,143,556 | A | 11/2000 | Trachtenberg |
| 6,689,601 | B2 | 2/2004 | Koffas et al. |
| 6,818,424 | B2 | 11/2004 | DiCosimo et al. |
| 7,098,005 | B2 | 8/2006 | Dicosimo et al. |
| 8,005,620 | B2 | 8/2011 | Gustafsson et al. |
| 8,129,154 | B2 | 3/2012 | Burk et al. |
| 2002/0168733 | A1 | 11/2002 | Clark et al. |
| 2003/0003528 | A1 | 1/2003 | Brzostowicz et al. |
| 2003/0032141 | A1 | 2/2003 | Nguyen et al. |
| 2003/0032170 | A1 | 2/2003 | Ito et al. |
| 2003/0203456 | A1* | 10/2003 | Clark ................... C12N 1/005 435/123 |
| 2005/0176121 | A1* | 8/2005 | Takeshita ................ C12P 7/04 435/155 |
| 2007/0087403 | A1 | 4/2007 | Bestel-Corre et al. |
| 2008/0026005 | A1 | 1/2008 | Miguez et al. |
| 2008/0292918 | A1 | 11/2008 | Finnerty et al. |
| 2008/0293101 | A1 | 11/2008 | Peters et al. |
| 2010/0221813 | A1 | 9/2010 | Miguez et al. |
| 2010/0291653 | A1 | 11/2010 | Ness et al. |

FOREIGN PATENT DOCUMENTS

| | | | |
|---|---|---|---|
| CN | 1763178 A | 4/2006 | |
| CN | 101392233 A * | 3/2009 | |
| EP | 0 296 484 A2 | 12/1988 | |
| EP | 1433856 A1 * | 6/2004 | ............... C12P 7/02 |
| WO | 02/18617 A2 | 3/2002 | |

OTHER PUBLICATIONS

Hanson et al., Methanotrophic bacteria, Microbiol. Rev., 1996, 60, 439-71.*
Ui Haque et al., Marker Exchange Mutagenesis of mxaF, Encoding the Large Subunit of the Mxa Methanol Dehydrogenase, in Methylosinus trichosporium OB3b, Appl. Environ. Microbiol., 2016, 82, 1549-55.*
Toyama et al., Construction of insertion and deletion mxa mutants of Methylobacerium extorquens AM1 by electroporation, FEMS Microbiol. Lett., 1998, 166, 1-7.*
GenBank, Accession No. L40804.2, 2001, www.ncbi.nlm.gov.*
English language machine translation of Chinese Patent 10129223, 2009.*
GenBank, Accession No. AAU92947, 2011, www.ncbi.nlm.gov.*
GenBank, Accession No. AAU92153, 2011, www.ncbi.nlm.gov.*
GenBank, Accession No. AAU91107, 2011, www.ncbi.nlm.gov.*
Guo et al., Protein tolerance to random amino acid change, Proc. Natl. Acad. Sci. USA, 2004, 101, 9205-10.*
Tsubota et al., Methylothermus thermalis gen. nov., sp. nov., a novel moderately thermophilic obligate methanotroph from a hot spring in Japan, Int. J. Syst. Evol. Microbiol., 2005, 55, 1877-84.*
Hirayama et al., Methylothermus subterraneus sp. nov., a moderately thermophilic methanotroph isolated from a terrestrial subsurface hot aquifer, Int. J. Systematic Evolutionary Microbiol., 2011, 61, 2646-53.*

(Continued)

*Primary Examiner* — Robert B Mondesi
*Assistant Examiner* — Todd M Epstein
(74) *Attorney, Agent, or Firm* — Seed Intellectual Property Law Group LLP

(57) ABSTRACT

The present disclosure relates to genetically engineered microorganisms for biological oxidation of hydrocarbons, including production of alcohols from alkanes or epoxides from alkenes, and related methods and systems.

16 Claims, 2 Drawing Sheets
Specification includes a Sequence Listing.

(56) References Cited

OTHER PUBLICATIONS

Uniprot, Accession No. D1MYY0, 2010, www.uniprot.org.*
Chan et al., Overexpression and Purification of the Particulate Methane Monooxygenase from Methylococcus capsulatus, Methods Enz., 2011, 495, 177-93.*
Akhverdyan et al., "Application of the bacteriophage Mu-driven system for the integration/amplification of target genes in the chromosomes of engineered Gram-negative bacteria-mini review," *Appl Microbiol Biotechnol* 91:857-871, 2011.
Ali et al., "Duplication of the mmoX gene in *Methylosinus sporium*: cloning, sequencing and mutational analysis," *Microbiology* 152:2931-2942, 2006.
Anderson et al., "Nucleotide Sequence of the *Methylobacterium Extorquens* AM1 moxF and moxJ genes involved in methanol oxidation," *Gene* 90:173-176, 1990.
Anthony et al. "The Microbial Oxidation of Methanol—The Prosthetic Group of the Alcohol Dehydrogenase of *Pseudomonas* sp. M27: A New Oxidoreductase Prosthetic Group," *Biochem. J.* 104:960-969, 1967.
Anthony et al., "The Microbial Oxidation of Methanol—The Alcohol Dehydrogenase of *Pseudomonas* SP. M27," *Biochem. J.* 96:808-812,1965.
Anthony et al., "The structure and mechanism of methanol dehydrogenase," *Biochimica et Biophysica Acta* 1647 :18-23, 2003.
Balasubramanian et al., "Oxidation of methane by a biological dicopper centre," *Nature* 465(7294):115-119, 2010.
Bennetzen et al., "The primary structure of the *Saccharomyces cerevisiae* Gene for Alcohol Dehydrogenase I," *The Journal of Biological Chemistry* 257(6):3018-3025, 1982.
Brosius, "Toxicity of an overproduced foreign gene product in *Escherichia coli* and its use in plasmid vectors for the selection of transcription terminators," *Gene* 27:161-172, 1984.
Brusseau et al., "Optimization of trichloroethylene oxidation by methanotrophs and the use of a colorimetric assay to detect soluble methane monooxygenase activity," *Biodegradation* 1 :19-29, 1990.
Cardy et al., "Molecular analysis of the methane monooxygenase (MMO) gene cluster of *Methylosinus trichosporium* OB3b," *Molecular Microbiology* 5(2):335-342,1991.
Cardy et al., "The methane monooxygenase gene cluster of *Methylosinus trichosporium*: cloning and sequencing of the mmoC gene," *Archives of Microbiology* 156:477-483, 1991.
Chen et al., "Comparison of random mutagenesis and semi-rational designed libraries for improved cytochrome P450 BM3-catalyzed hydroxylation of small alkanes," *Protein Engineering, Design & Selection* 25(4):171-178, 2011.
Colby et al., "The Soluble Methane Mono-oxygenase of *Methylococcus capsulatus* (Bath)—Its Ability to Oxygenate n-alkanes, n-alkenes, Ethers, and Alicyclic, Aromatic and Heterocyclic Compounds," *Biochem. J.* 165:395-402, 1977.
Coufal et al., "Sequencing and analysis of the *Methylococcus capsulatus* (Bath) soluble methane monooxygenase genes," *Eur. J. Biochem.* 267:2174-2185, 2000.
DiSpirito et al., "Trichloroethylene oxidation by the membrane-associated methane monooxygenase in type I, type II and type X methanotrophs," *Biodegradation* 2(3) :151-164, 1992.
Fennell et al., "Methanotrophic Attached-Film Reactor Development and Biofilm Characteristics," *Biotechnology and Bioengineering* 40:1218-1232, 1992.
Föllner et al., "Expression of polyhydroxyalkanoic-acid-biosynthesis genes in methylotophic bacteria relying on the ribose monophosphate pathway," *Applied Microbiology and Biotechnology* 40:284-291, 1993.
Fujii et al., "Biotransformation of Various Alkanes Using the *Escherichia coli* Expressing an Alkane Hydroxylase System from *Gordonia* sp. TF6," *Biosci. Biotechnol. Biochem* 68(10):2171-2177, 2004.
Funhoff et al., "CYP153A6, a Soluble P450 Oxygenase Catalyzing Terminal-Alkane Hydroxylation," *Journal of Bacteriology* 188(14):5220-5227, 2006.

Gilbert et al., "Molecular Analysis of the pmo (Particulate Methane Monooxygenase) Operons from Two Type II Methanotrophs," *Applied and Environmental Microbiology* 66(3):966-975, 2000.
Gou et al., "Functional expression of the particulate methane mono-oxygenase gene in recombinant *Rhodococcus erythropolis*," *FEMS Microbiol Lett* 263(2):136-141, 2006.
Guo et al., "Physiological analysis of *Methylobacterium extorquens* AM1 grown in continuous and batch cultures," *Arch Microbiol* 186(2):139-149, 2006.
Han et al., "Heterologous expression of particulate methane monooxygenase in different host cells," *Chin J Biotech* 25(8):1151-1159, 2009. (with English Abstract).
Hanczár et al., "Detection and localization of two hydrogenases in *Methylococcus capsulatus* (Bath) and their potential role in methane metabolism," *Arch Microbiol* 177:167-172, 2002.
Hou et al., "Complete genome sequence of the extremely acidophilic methanotroph isolate V4, *Methylacidiphilum infernorum*, a representative of the bacterial phylum *Verrucomicrobia*," *Biology Direct* 3(26), 2008. (25 pages).
Hyman et al., "Interaction of Ammonia Monooxygenase from *Nitrosomonas europaea* with Alkanes, Alkenes, and Alkynes," *Applied and Environmental Microbiology* 54(12):3187-3190, 1988.
Jahng et al., "Optimization of Trichloroethylene Degradation Using Soluble Methane Monooxygenase of *Methylosinus trichosporium* OB3b Expressed in Recombinant Bacteria," *Biotechnology and Bioengineering* 51:349-359, 1996.
Jiang et al, "Methanotrophs: Multifunctional bacteria with promising applications in environmental bioengineering," *Biochemical Engineering Journal* 49:277-288, 2010.
Kalyuzhnaya et al., "Characterization of a Novel Methanol Dehydrogenase in Representatives of Burkholderiales: Implications for Environmental Detection of Methylotrophy and Evidence for Convergent Evolution," *Journal of Bacteriology* 190(11):3817-3823, 2008.
Kubota et al., "Isolation and Functional Analysis of Cytochrome P450 CYP153A Genes from Various Environments," *Biosci. Biotechnol. Biochem.* 69(12):2421-2430, 2005.
Lieberman et al., "Purified particulate methane monooxygenase from *Methylococcus capsulatus* (Bath) is a dimer with both mononuclear copper and a copper-containing cluster," *PNAS* 100(7):3820-3825, 2003.
Lloyd et al., "Heterologous expression of soluble methane monooxygenase genes in methanotrophs containing only particulate methane monooxygenase," *Arch Microbiol* 171:364-370, 1999.
Lu et al., "Biosynthesis of Monomers for Plastics from Renewable Oils," *J. Am. Chem. Soc.* 132(43):15451-15455, 2010.
Martin et al, "Methane monooxygenase mutants of *Methylosinus trichosporium* constructed by marker-exchange mutagenesis," *FEMS Microbiology Letters* 127:243-248, 1995.
Minshull et al., "Predicting enzyme function from protein sequence," *Current Opinion in Chemical Biology* 9:202-209, 2005.
Minshull et al., "Engineered protein function by selective amino acid diversification," *Methods* 32:416-427, 2004.
Murphy, "Targeted chromosomal gene knockout using PCR fragments," *Methods in Molecular Biology* 756:27-42, 2011.
Nelson et al., "P450 superfamily: update on new sequences, gene mapping, accession numbers and nomenclature," *Pharacogenetics* 6:1-42, 1996.
Nguyen et al., "The Nature of the Copper Ions in the Membranes Containing the Particulate Methane Monooxygenase from *Methylococcus capsulatus* (Bath)," *The Journal of Biological Chemistry* 269(21):14995-15005, 1994.
Norton et al., "Diversity of ammonia monooxygenase operon in autotrophic ammonia-oxidizing bacteria," *Arch Microbiol* 177:139-149, 2002.
Patel et al. "Microbial Oxidation of Hydrocarbons: Properties of a Soluble Methane Monooxygenase from a Facultative Methane-Utilizing Organism, *Methylobacterium* sp. Strain CRL-26," *Applied and Environmental Microbiology* 44(5):1130-1137, 1982.
Pfluger et al., "Selection of Type I and Type II methanotrophic proteobacteria in a fluidized bed reactor under non-sterile conditions," *Bioresource Technology* 102(21):9919-9926, 2011.

(56) References Cited

OTHER PUBLICATIONS

Reid et al., "Molecular Characterization of Microbial Alcohol Dehydrogenases," *Crit Rev Microbiol.* 20(1):13-56, 1994.

Ruggeri et al., "Determination of Optimal Biofilm Activity in a Biological Fluidized Bed (BFB) Reactor," *Water Science and Technology* 29(10-11):347-351, 1994.

Schmidt et al., "Functional investigation of methanol dehydrogenase-like protein XoxF in *Methylobacterium extorquens* AM1," *Microbiology* 156:2575-2586, 2010.

Semrau et al., "Particulate Methane Monooxygenase Genes in Methanotrophs," *Journal of Bacteriology* 177(11):3071-3079, 1995.

Springer et al., "Sequence and characterization of mxaB, a response regulator involved in regulation of methanol oxidation, and of mxaW, a methanol-regulated gene in *Methylobacterium extorquens* AM1," *FEMS Microbiol Lett.* 160:119-124, 1998.

Stainthorpe et al., "Molecular analysis of methane monooxygenase from *Methylococcus capsulatus* (Bath)," *Archives of Microbiology* 152:154-159, 1989.

Stainthorpe et al., "The methane monooxygenase gene cluster of *Methylococcus capsulatus* (Bath)," *Gene* 91:27-34, 1990.

Stolyar et al., "Role of multiple gene copies in particulate methane monooxygenase activity in the methane-oxidizing bacterium *Methylococcus capsulatus* Bath," *Microbiology* 145:1235-1244, 1999.

Toyama et al., "Sequence analysis of pqq genes required for biosynthesis of pyrroloquinoline quinone in *Methylobacterium extorquens* AM1 and the purification of a biosynthetic intermediate," *Microbiology* 143:595-602, 1997.

Toyoma et al., "pqqA is not required for biosynthesis of pyrroloquinoline quinone in *Methylobacterium extorquens* AM1," *Microbiology* 144:183-191, 1998.

Van Dien et al., "Reconstruction of $C_3$ and $C_4$ metabolism in *Methylobacterium extorquens* AM1 using transposon mutagenesis," *Microbiology* 149:601-609, 2003.

Villalobos et al., "Gene Designer: a synthetic biology tool for constructing artificial DNA segments," *BMC Bioinformatics* 7(285), 8 pages, 2006.

Wadzinski et al., "Oxidation of $C_1$ Compounds by Particulate Fractions from *Methylococcus capsulatus*: Properties of Methanol Oxidase and Methanol Dehydrogenase," *Journal of Bacteriology* 122(3):1364-1374, 1975.

Ward et al., "Genomic Insights into Methanotrophy: The Complete Genome Sequence of *Methylococcus capsulatus* (Bath)," *PLoS Biology* 2(10):1616-1628, 2004.

Welch et al., "You're one in a googol: optimizing genes for protein expression," *J. R. Soc. Interface* 6: S467-S476, 2009.

Welch et al., "Design Parameters to Control Synthetic Gene Expression in *Escherichia coli*," *PLoS One* 4(9):e7002, 2009. (10 pages).

Zahn et al., "Membrane-Associated Methane Monooxygenase from *Methylococcus capsulatus* (Bath)," *Journal of Bacteriology* 178(4): 1018-1029, 1996.

Zhong et al., "Targeted and random bacterial gene disruption using a group II intron (targetron) vector containing a retrotransposition-activated selectable marker," *Nucleic Acids Res.* 31(6):1656-1664, 2003.

\* cited by examiner

GENETICALLY ENGINEERED MICROORGANISMS FOR BIOLOGICAL OXIDATION OF HYDROCARBONS

STATEMENT REGARDING SEQUENCE LISTING

The Sequence Listing associated with this application is provided in text format in lieu of a paper copy, and is hereby incorporated by reference into the specification. The name of the text file containing the Sequence Listing is 200206_408WO_SEQUENCE_LISTING.txt. The text file is 1 GB, was created on Oct. 14, 2013, and is being submitted electronically via EFS-Web.

BACKGROUND

Technical Field

The present disclosure relates to genetically engineered microorganisms for biological oxidation of hydrocarbons including production of alcohols from alkanes or epoxides from alkenes, such as methanol from methane, and methods and systems for oxidation of hydrocarbons.

Description of the Related Art

Unconventional gas is a collective term used to describe tight gas sands, gas shales, gas hydrates, and coal bed methane. Methane is the principal component of natural gas (~75%), with other constituents, including ethane, propane, butane (~20%), smaller quantities of $CO_2$, oxygen, nitrogen, hydrogen sulphide, and trace amounts of rare gases. These other constituents are separated from methane to produce sales grade natural gas. Unconventional gas is the same substance as "conventional" natural gas; it is the particular characteristics of the gas reservoirs that lead to its "unconventional" name. While conventional natural gas can be exploited without any special well completions, most unconventional gas production requires rock fracturing to allow the gas to escape the rock through the wellbore to the surface. Unconventional gas deposits make up an increasing proportion of natural gas left to be extracted in North America.

The abundance of cheap natural gas resources presents an opportunity for using methane-based fuels and chemicals, thus reducing reliance on petroleum imports. However, traditional catalytic processes for converting natural gas into higher value products are costly and have numerous processing requirements, environmental conditions (e.g., high pressure and temperature), and safety concerns. While bioconversion approaches provide a potential alternative, previous strategies, such as using native methanotrophic bacteria to produce methanol from methane, provide insufficient process yields and low efficiency for commercial use.

In view of the limitations associated with conversion of methane and other components of natural gas into higher value fuels and chemicals, there is clearly a need in the art for new methods which are safe, efficient, specific, environmentally clean, and cost-effective. The present invention addresses this problem by providing efficient and cost-effective methods for biosynthetic production of methanol and other alcohol products from alkanes using genetically engineered microorganisms. Furthermore, the biocatalyst for alkane oxidation is also capable of converting alkene substrates to epoxides, a reaction which is currently underserved by chemical catalysis methods.

SUMMARY OF INVENTION

In one aspect, the present disclosure provides non-naturally occurring microorganisms comprising: an exogenous nucleic acid encoding an enzyme with methane monooxygenase activity that is stable in the presence of a chemical or environmental stress; wherein at least one alcohol dehydrogenase is inactivated in the microorganism; and wherein the microorganism is capable of converting methane into methanol. In certain embodiments, the non-naturally occurring microorganisms are methanotrophic bacteria.

In certain embodiments, the microorganisms are capable of utilizing $H_2$ as a reducing agent for converting methane into methanol. In further embodiments, the microorganisms comprise a nucleic acid encoding a hydrogenase enzyme that is capable of utilizing $H_2$ as a reducing agent for converting methane into methanol.

In certain embodiments, the enzyme with methane monooxygenase activity is pMMO, sMMO, AMO, or P450. In certain embodiments, the enzyme with methane monooxygenase activity comprises an amino acid sequence having at least 70% identity to any one of SEQ ID NOs: 1-654.

In certain embodiments, the chemical or environmental stress is a temperature >60° C., a pH>9, or a pH<5, or a temperature of at least 60° C., a pH of at least 9, or a pH of 5 or below.

In certain embodiments, the alcohol dehydrogenase is inactivated by genetic modification. In other embodiments, the alcohol dehydrogenase is inactivated by the chemical or environmental stress. In certain embodiments, the chemical or environmental stress is a temperature of at least 60° C., a pH of at least 9, or a pH of 5 or below. In certain embodiments, the alcohol dehydrogenase may include methanol dehydrogenase. In certain embodiments, the alcohol dehydrogenase comprises an amino acid sequence having at least 70% identity to any one of SEQ ID NOs:655, 656, 657, 658, 659, 660, 661, 662, 663, 664, and 665.

In certain embodiments, the microorganism is capable of converting ethane into ethanol, propane into propanol, butane into butanol, or a mixed alkane gas substrate into a mixed alcohol product. In some embodiments, the mixed alkane gas substrate is wet natural gas or a partially separated derivative thereof.

In certain embodiments, the microorganism is capable of converting ethylene into ethylene oxide, propylene into propylene oxide, butene into butene oxide, butadiene into butadiene 1,2 oxide, or a mixed alkene gas substrate into a mixed epoxide product.

The present disclosure also provides methods for converting methane and other light alkanes into their corresponding alcohols, for converting light alkenes into their corresponding epoxides, and systems comprising the non-naturally occurring microorganisms.

These and other aspects of the present disclosure will become apparent upon reference to the following detailed description and attached drawings. All references disclosed herein are hereby incorporated by reference in their entirety as if each was incorporated individually.

DETAILED DESCRIPTION

Figure 1:
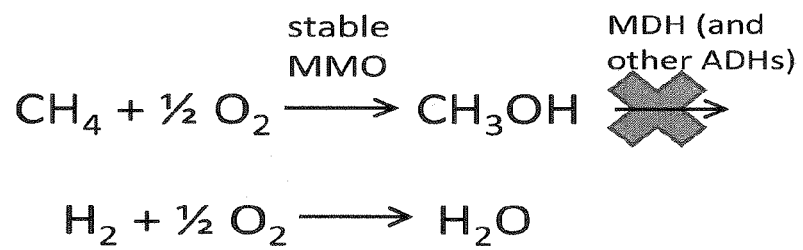
FIG. 1 shows an exemplary methanol biosynthesis pathway as provided in the present disclosure, showing separation of methanol biosynthesis into two catalytic steps performed sequentially and inhibition of endogenous MDH and other ADH activities.

The instant disclosure provides compositions, methods, and systems for specific oxidation of hydrocarbons, including mixed gas substrates, into mixed oxidized products, in which microorganisms are genetically engineered to: include an exogenous nucleic acid encoding an enzyme with methane monooxygenase activity that is stable in the presence of a chemical or environmental stress, and have at least one alcohol dehydrogenase that is inactivated in the microorganism. As provided herein, methods for oxidizing hydrocarbons, including converting alkanes into their corresponding alcohols or alkenes into their corresponding epoxides, comprising, providing the genetically engineered microorganisms or cell-free fraction derived thereof and exposing them to: $O_2$; a gas substrate comprising a light alkane (e.g., methane, ethane, propane, or butane), a light alkene (e.g., ethylene, propylene, butylene, or butadiene) or a mixed gas substrate comprising light alkanes and/or alkenes; and a reducing agent; wherein the alkane(s) is subsequently converted to its corresponding alcohol(s) and/or the alkene(s) is subsequently converted to its corresponding epoxide(s). The genetically engineered microorganisms or cell-free fractions derived thereof may be immobilized on a solid matrix and incorporated into systems for converting alkanes into alcohols and alkenes into epoxides comprising a gas phase bioreactor.

Prior to setting forth this disclosure in more detail, it may be helpful to an understanding thereof to provide definitions of certain terms to be used herein. Additional definitions are set forth throughout this disclosure.

In the present description, the term "about" means±20% of the indicated range, value, or structure, unless otherwise indicated. The term "consisting essentially of" limits the scope of a claim to the specified materials or steps and those that do not materially affect the basic and novel characteristics of the claimed invention. It should be understood that the terms "a" and "an" as used herein refer to "one or more" of the enumerated components. The use of the alternative (e.g., "or") should be understood to mean either one, both, or any combination thereof of the alternatives. As used herein, the terms "include" and "have" are used synonymously, which terms and variants thereof are intended to be construed as non-limiting. The term "comprise" means the presence of the stated features, integers, steps, or components as referred to in the claims, but that it does not preclude the presence or addition of one or more other features, integers, steps, components, or groups thereof.

As used herein, the term "non-naturally occurring", also known as "recombinant," when used in reference to a microorganism means that the microorganism has at least one genetic alternation that is not normally found in a naturally occurring strain of the referenced species, including wild-type strains of the referenced species. Genetic alterations include, for example, modifications introducing expressible nucleic acid molecules encoding proteins, other nucleic acid additions, nucleic acid deletions, nucleic acid substitutions, or other functional disruption of the bacterium's genetic material. Such modifications include, for example, coding regions and functional fragments thereof for heterologous or homologous polypeptides for the referenced species. Additional modifications include, for example, non-coding regulatory regions in which the modifications alter expression of a gene or operon. Exemplary proteins include proteins within a methane oxidation pathway (e.g., methane monooxygenase). Genetic modifications to nucleic acid molecules encoding enzymes, or functional fragments thereof, can confer a biochemical reaction capability or a metabolic pathway capability or improvements of such capabilities to the non-naturally occurring microorganism that is altered from its naturally occurring state. As used herein, the term "microorganism," also known as "microbial organism," "microbes," or "organism," refers to any prokaryotic or eukaryotic microbial species from the domains of Archaea, Bacteria, or Eukarya. The term is intended to include prokaryotic or eukaryotic organisms having microscopic size.

As used herein, the term "methanotrophic bacterium" refers to an obligate methylotrophic bacterium that has the ability to oxidize methane as its primary carbon and energy source.

As used herein, "methane" refers to the simplest alkane compound with the chemical formula $CH_4$. Methane is a colorless and odorless gas at room temperature and pressure. Sources of methane include natural sources, such as natural gas fields and biological synthesis via methanogenic microorganisms, and industrial or laboratory synthesis. Methane includes pure methane, substantially purified compositions, such as "pipeline quality natural gas" or "dry natural gas", which is 95-98% percent methane, and unpurified compositions, such as "wet natural gas", wherein other hydrocarbons have not yet been removed and methane comprises more than 60% of the composition.

As used herein, "natural gas liquids", also known as "natural gas associated hydrocarbons" refers to the various hydrocarbons (e.g., ethane, propane, butane) that are separated from wet natural gas during processing to produce pipeline quality dry natural gas. "Partially separated derivative of wet natural gas" includes natural gas liquids.

As used herein, an "enzyme with methane monooxygenase activity" refers to any enzyme capable of oxidizing the C—H bond in methane to form methanol. An enzyme with methane monooxygenase activity may possess oxidizing activity on a variety of other substrates besides methane (e.g., ethane, propane, butane, ethylene, propylene, butene, or butadiene). An enzyme with methane monooxygenase activity includes a multi-component enzyme as well as a subunit comprising an active site. Exemplary enzymes with methane monooxygenase activity include pMMO, sMMO, ammonia monooxygenase, and P450.

As used herein, "stable" when used in reference to an enzyme with catalytic activity (e.g., methane monooxygenase activity) and a chemical or environmental stress, means that the enzyme retains substantial activity during exposure to a chemical or environmental stress, i.e., at least 25% or more catalytic activity under the stress condition as compared to without the stress condition. As used herein, reference to an enzyme with catalytic activity that has been genetically engineered to be "stable" in the presence of a chemical or environmental stress may also mean that the engineered enzyme retains significant catalytic activity during exposure to a chemical or environmental stress as compared to a wild-type or reference enzyme exposed to the same stress condition (i.e., wild type or reference enzyme retains less than 25% catalytic activity during exposure to stress condition than normal condition).

As used herein, "chemical stress" or "environmental stress" refers to chemical or environmental conditions that affect the ability of a microorganism to metabolize normally, survive, or the ability of a protein or enzyme derived from the microorganism to function.

As used herein, "$H_2$", also known as "molecular hydrogen" refers to a colorless, odorless dihydrogen gas. It is the smallest gas molecule and made of two protons and two electrons.

As used herein, "reducing agent", also known as "reductant," "reducer," or "reducing equivalent," refers to an element or compound that donates an electron to another species.

As used herein, "alcohol dehydrogenase" (ADH) refers to any enzyme capable of converting an alcohol into its corresponding aldehyde, ketone, or acid. An alcohol dehydrogenase may have general specificity, capable of converting at least several alcohol substrates, or may have narrow specificity, accepting one or two alcohol substrates.

As used herein, "methanol dehydrogenase" (MDH) refers to a type of alcohol dehydrogenase that catalyzes the conversion of methanol to formaldehyde.

As used herein, "methanol", also known as "methyl alcohol" or "wood alcohol" refers to a colorless, water-soluble liquid having the chemical formula $CH_3OH$.

As used herein, "particulate methane monooxygenase" (pMMO) refers to a membrane-bound particulate enzyme that catalyzes the oxidation of methane to methanol in methanotrophic bacteria. pMMO includes both the multi-component enzyme as well as the subunit comprising the enzyme's active site.

As used herein, "soluble methane monooxygenase" (sMMO) refers to an enzyme found in the soluble fraction of cell lysates (cytoplasm) that catalyzes the oxidation of methane to methanol in methanotrophic bacteria. sMMO includes both the multi-component enzyme as well as the subunit comprising the enzymes active site.

As used herein, "P450", also known as "cytochrome P450" or "CYP," refers to a group of enzymes with broad substrate specificity that catalyze the oxidation of organic compounds, most commonly a monooxgenase reaction inserting an oxygen atom into the R—H bond of an organic substrate.

As used herein, "$H_2$ reducing agent" refers to molecular hydrogen ($H_2$) that acts as an electron donor to power catalysis by an enzyme with methane monooxygenase activity.

As used herein, "inactivated" used in reference to an enzyme (e.g., alcohol dehydrogenase) means that the enzyme possesses less than 25% activity as compared to a wild type or reference enzyme. Inactivation may be accomplished by genetic methods, such as inhibiting transcription or expression or by using environmental conditions, such as high temperature. Chemical inactivation may be accomplished by high acidity or alkalinity, high salt concentrations, or exposure to specific chemicals.

As used herein, "mixed alkane gas substrate" refers to a gaseous composition containing a mixture of two or more lower alkanes (i.e., any combination of two or more alkanes from the group consisting of methane, ethane, propane, and butane).

As used herein, "mixed alcohol product" refers to a composition containing a mixture of two or more lower alcohols (e.g., any combination of two or more alcohols from the group consisting of methanol, ethanol, propanol, and butanol).

The alcohol composition in the mixed alcohol product is dependent upon the alkane composition of the mixed alkane gas substrate oxidized by the non-naturally occurring microorganisms.

As used herein, "mixed alkene gas substrate" refers to a gaseous composition containing a mixture of two or more lower alkenes (i.e., any combination of two or more alkenes from the group consisting of ethylene, propylene, butene and butadiene).

As used herein, "mixed epoxide product" refers to a composition containing a mixture of two or more lower epoxides (e.g., any combination of two or more epoxides from the group consisting of ethylene oxide, propylene oxide, and butylene oxide). The epoxide composition in the mixed epoxide product is dependent upon the alkene composition of the mixed alkene gas substrate oxidized by the non-naturally occurring microorganisms.

As used herein "butylene," also known as "butene," refers to a hydrocarbon with the formula $C_4H_8$. There are several isomers of butylenes, depending on the starting isomer of butane and the positions of the free bonds. Butylene includes, for example, 1,1-butylene; 1,2-butylene; 2,2-butylene; 1,3-butylene; 2,3-butylene (cis and trans); 1,4-butylene; 1,1-isobutylene; 1,2-isobutylene; and 1,3-isobutylene.

As used herein, "butadiene", also known as "1,3-butadiene", refers to a simple conjugated diene with the formula $C_4H_6$. "Butadiene" may also include the 1,2-butadiene isomer.

As used herein, "exogenous" means that the referenced molecule (e.g., nucleic acid) or referenced activity (e.g., methane monooxygenase activity) is introduced into a host microorganism. The molecule can be introduced, for example, by introduction of a nucleic acid into the host genetic material such as by integration into a host chromosome or by introduction of a nucleic acid as non-chromosomal genetic material, such as on a plasmid. When the term is used in reference to expression of an encoding nucleic acid, it refers to introduction of the encoding nucleic acid in an expressible form into the host microorganism. When used in reference to an enzymatic or protein activity, the term refers to an activity that is introduced into the host reference microorganism. Therefore, the term "endogenous" or "native" refers to a referenced molecule or activity that is present in the host microorganism. The term "chimeric" when used in reference to a nucleic acid refers to any nucleic acid that is not endogenous, comprising sequences that are not found together in nature. For example, a chimeric nucleic acid may comprise regulatory sequences and coding sequences that are derived from different sources, or regulatory sequences and coding sequences that are derived from the same source, but arranged in a manner different than that found in nature. The term "heterologous" refers to a molecule or activity that is derived from a source other than the referenced species or strain whereas "homologous" refers to a molecule or activity derived from the host microorganism. Accordingly, a microorganism comprising an exogenous nucleic acid as provided in the present disclosure can utilize either or both a heterologous or homologous nucleic acid.

It is understood that when an exogenous nucleic acid is included in a microorganism that the exogenous nucleic acid refers to the referenced encoding nucleic acid or protein activity, as discussed above. It is also understood that such an exogenous nucleic acid can be introduced into the host microorganism on separate nucleic acid molecules, on a polycistronic nucleic acid molecule, on a single nucleic acid molecule encoding a fusion protein, or a combination thereof, and still be considered as more than one exogenous nucleic acid. For example, as disclosed herein, a microorganism can be modified to express two or more exogenous nucleic acids encoding an enzyme with methane monooxygenase activity (e.g., nucleic acids encoding pMMO and AMO). Where two exogenous nucleic acids encoding enzymes with methane monooxygenase activity are introduced into a host microorganism, it is understood that the two exogenous nucleic acids can be introduced as a single nucleic acid molecule, for example, on a single plasmid, on separate plasmids, can be integrated into the host chromosome at a single site or multiple sites, and still be considered two exogenous nucleic acids. Similarly, it is understood that more than two exogenous nucleic acid molecules can be introduced into a host microorganism in any desired combination, for example, on a single plasmid, on separate plasmids, can be integrated into the host chromosome at a single site or multiple sites, and still be considered as two or more exogenous nucleic acids. Thus, the number of referenced exogenous nucleic acids or enzymatic activities refers to the number of encoding nucleic acids or the number of protein activities, not the number of separate nucleic acid molecules introduced into the host microorganism.

As used herein, "nucleic acid", also known as polynucleotide, refers to a polymeric compound comprised of covalently linked subunits called nucleotides. Nucleic acids include polyribonucleic acid (RNA), polydeoxyribonucleic acid (DNA), both of which may be single or double stranded. DNA includes cDNA, genomic DNA, synthetic DNA, and semi-synthetic DNA.

As used herein, "cell-free fraction" when used in reference to a non-naturally occurring microorganism refers to fractions (e.g., organelles, cytoplasm) that have been separated from a cell. A cell-free fraction may be relatively unpurified (e.g., cell lysate). Cell-free fractions also include relatively purified organelle fractions separated by differential centrifugation.

As used herein, "gas phase bioreactor", also known as a "gas phase reactor" refers to a manufactured or engineered device or system that supports a biologically active environment, in which microorganisms or cell-free fractions derived from the microorganisms contact and catalyze a gas substrate. A biologically active environment may comprise microorganism growth or a chemical process carried by out the microorganisms (i.e., methane monooxygenase activity) or catalytically active cell-free fractions derived from such microorganisms. Microorganisms or cell-free fractions derived thereof may be immobilized to a solid matrix within the reactor or to surfaces comprising the reactor itself.

As used herein, "fluidized bed reactor", also known as "fluidized bed bioreactor," refers to a bioreactor that is a combination of packed bed and stirred tank, continuous flow reactors. In a fluidized bed reactor, microorganisms or cell-free fractions derived thereof attached to particle bed carriers are suspended by upward passage of fluid (gas or liquid) such that the particle bed carriers freely circulate in the fluid. Fluidized bed reactors have excellent mass and heat transfer characteristics. As used herein, "solid matrix" refers to a solid substance capable of having microorganisms or cell-free fractions derived from the microorganisms temporarily or permanently attached on, within, or behind the solid matrix. Immobilized microorganisms may grow on the surface of the solid matrix (e.g., as a biofilm). Solid matrix supports may be in a variety of shapes, such as sheets, rings, beads, and may comprise a number of materials, including polypropylene, sand, granular activated carbon, diatomaceous earth, and ceramics.

Non-Naturally Occurring Microorganisms

In certain embodiments, provided are non-naturally occurring microorganisms that are genetically engineered to comprise an exogenous nucleic acid encoding an enzyme with methane monooxygenase activity that is stable in the presence of a chemical or environmental stress, wherein at least one alcohol dehydrogenase enzyme is inactivated in the microorganism, and wherein the microorganism is capable of converting methane into methanol.

Transformation refers to the transfer of a nucleic acid (e.g., exogenous nucleic acid) into the genome of a host microorganism, resulting in genetically stable inheritance. Host microorganisms containing the transformed nucleic acid are referred to as "non-naturally occurring" or "recombinant" or "transformed" or "transgenic" microorganisms. Host microorganisms may be selected from, and the non-naturally occurring microorganisms generated in, any prokaryotic or eukaryotic microbial species from the domains of Archaea, Bacteria, or Eukarya. Exemplary bacteria include *Escherichia coli, Klebsiella oxytoca, Anaerobiospirillum succiniciproducens, Actinobacillus succinogenes, Mannheimia succiniciproducens, Rhizobium etli, Bacillus subtilis, Corynebacterium glutamicum, Gluconobacter oxydans, Zymomonas mobilis, Lactococcus lactis, Lactobacillus plantarum, Streptomyces coelicolor, Clostridium acetobutylicum, Pseudomonas fluorescens*, and *Pseudomonas putida*. Exemplary yeasts or fungal species include *Saccharomyces cerevisiae, Schizosaccharomyces pombe, Kluyveromyces lactis, Kluyveromyces marxianus, Aspergillus terreus, Aspergillus niger, Rhizopus arrhizus, Rhizopus oryzae, Candida, Yarrowia, Hansenula, Pichia pastoris, Torulopsis, Rhodotorula* and *Yarrowia lipolytica*. It is understood that any suitable host microorganism can be used to introduce suitable genetic modifications (e.g., an exogenous nucleic acid encoding an enzyme with methane monooxygenase activity that is stable in the presence of a chemical or environmental stress) to produce a non-naturally occurring microorganism as provided in the specification.

In some embodiments, a host microorganism may be a methylotrophic bacterium, which can oxidize C1 compounds (lacking carbon-carbon bonds), or a methanotrophic bacterium, which generally are obligate methylotrophic bacteria that have the ability to oxidize methane as a carbon and energy source. Methanotrophic bacteria are classified into three groups based on their carbon assimilation pathways and internal membrane structure: type I (gamma proteobacteria), type II (alpha proteobacteria, and type X (gamma proteobacteria). Type I methanotrophs use the ribulose monophosphate (RuMP) pathway for carbon assimilation whereas type II methanotrophs use the serine pathway. Type X methanotrophs use the RuMP pathway but also express low levels of enzymes of the serine pathway. Methanotrophic bacteria are grouped into several genera: *Methylomonas, Methylobacter, Methylococcus, Methylocystis, Methylosinus, Methylomicrobium, Methanomonas*, and *Methylocella*. Methanotrophic bacteria also include facultative methanotrophs, which naturally have the ability to utilize some multi-carbon substrates as a sole carbon and energy source. Facultative methanotrophs include some species of *Methylocella, Methylocystis*, and *Methylocapsa* (e.g., *Methylocella silvestris, Methylocella palustris, Methylocella tundrae, Methylocystis daltona* strain SB2, *Methylocystis bryophila*, and *Methylocapsa aurea* KYG). Exemplary methanotrophic bacteria include: *Methylococcus capsulatus* Bath strain, *Methylomonas* 16a (ATCC PTA 2402), *Methylosinus trichosporium* OB3b (NRRL B-11, 196), *Methylosinus sporium* (NRRL B-11,197), *Methylocystis parvus* (NRRL B-11,198), *Methylomonas methanica*

(NRRL B-11,199), *Methylomonas albus* (NRRL B-11,200), *Methylobacter capsulatus* (NRRL B-11,201), *Methylobacterium organophilum* (ATCC 27,886), *Methylomonas* sp AJ-3670 (FERM P-2400), *Methylocella silvestris, Methylocella palustris* (ATCC 700799), *Methylocella tundrae, Methylocystis daltona* strain SB2, *Methylocystis bryophila, Methylocapsa aurea* KYG, *Methylacidiphilum infernorum, Methylibium petroleiphilum*, and *Methylomicrobium alcaliphilum* 20Z.

Methylotrophic bacteria encompass a diverse group, including both gram-negative and gram-positive genera. Methylotrophic bacteria include facultative methylotrophs (have the ability to oxidize organic compounds which do not contain carbon-carbon bonds, but may also utilize other carbon substrates such as sugars and complex carbohydrates), obligate methylotrophs (limited to the use of organic compounds that do not contain carbon-carbon bonds), and methanotrophic bacteria. Examples of methylotrophic genera include: *Methylophilus, Methylobacillus, Methylobacterium, Hyphomicrobium, Xanthobacter, Bacillus, Paracoccus, Nocardia, Arthrobacter, Rhodopseudomonas*, and *Pseudomonas*. Exemplary methylotrophic bacteria include: *Methylobacterium extorquens, Methylobacterium radiotolerans, Methylobacterium populi, Methylobacterium chloromethanicum, Methylobacterium nodulans, Methylomonas clara, Methylibium petroleiphilum, Methylobacillus flagellates, Silicibacter pomeroyi* DSS-3, *Burkholderia phymatum* STM815, *Granulibacter bethesdensis* NIH1.1, and *Paracoccus denitrificans*.

A selected methanotrophic host bacteria may also undergo strain adaptation under selective conditions to identify variants with improved properties for production. Improved properties may include increased growth rate, yield of desired products, and tolerance of likely process contaminants (see, e.g., U.S. Pat. No. 6,689,601). In particular embodiments, a high growth variant methanotrophic bacteria, which is an organism capable of growth on methane as the sole carbon and energy source and which possesses an exponential phase growth rate that is faster (i.e., shorter doubling time) than its parent, reference, or wild-type bacteria, is selected.

In certain embodiments, an enzyme with methane monooxygenase activity is methane monooxygenase (MMO). Methane monooxygenases are enzymes expressed by methanotrophic bacteria. MMOs utilize an enzyme-associated metal center to split the O—O bond of dioxygen ($O_2$). One oxygen atom is reduced to form $H_2O$, while the other oxygen atom attacks a C—H bond of methane and is incorporated into methane to form methanol. A reducing agent is needed to complete the oxidation reaction and regenerate MMO. There are two types of MMOs found in methanotrophs, a soluble MMO (sMMO), which uses NADH as a reducing agent in vivo, and a particulate or membrane-bound MMO (pMMO), whose physiological reductant is at present undetermined. A number of other reducing agents have been used in vitro for MMOs, including formate, duroquinol, and $H_2$, and methods of testing reducing agents for driving MMO activity are known in the art (see, e.g., Shiemke et al., 1995, Arch. Biochem. Biophys. 321:421-8; U.S. Patent Publication 2003/0203456). pMMO is generally found in nearly all methanotrophic bacteria except for *Methylocella* genus, while a small subset of methanotrophs, such as *Methylococcus capsulatus* Bath and *Methylosinus trichosporium* OB3b, can express either sMMO or pMMO, depending on the copper concentration in the medium. sMMO comprises three components, a hydroxylase (MMOH) encoded by mmoXYZ, a reductase (MMOR) encoded by mmoC, and a regulatory protein (MMOB) encoded by mmoB. MMOH, which comprises the active site, consists of three polypeptides arranged as a $\alpha_2\beta_2\gamma_2$ dimer. mmoX encodes the a subunit which contains the active site. pMMO is composed of three subunits, α (pmoB), β (pmoA, contains active site), and γ (pmoC), arranged as a $\alpha_3\beta_3\gamma_3$ trimer. MMOs have a broad range of substrates, though sMMO has a wider range of substrate activity than pMMO. pMMO can also oxidize other alkanes, such as ethane, propane, butane, and pentane, into their corresponding alcohols (reviewed in Jiang et al., 2010, Biochemical Engineering Journal 49:277-288). pMMO can also oxidize propene into propene oxide; but-1-ene into 1,2-epoxybutane; 1,3-butadiene into 1,2-epoxybut-3-ene; cis-but-2-ene into cis-2,3-epoxybutane and crotonaldehyde; and trans-but-2-ene into trans-2,3-epoxybutane, crotonyl alcohol, and crotonaldehyde. sMMO can oxidize ethane, propane, butane, hexane, octane, and 2-methylpropane into their associated alcohols (Jiang et al., supra). sMMO can also oxide ethene into epoxyethane; propene into epoxypropane; but-1-ene into 1,2-epoxybutane; cis-but-2-ene into cis-2,3-epoxybutane and cis-2-buten-1-ol; and trans-but-2-ene into trans-2,3-epoxybutane and trans-2-buten-1-ol (Jiang et al., supra; Colby et al., 1977, Biochem J. 165:395-402). pMMO has higher specific activity and stability compared to sMMO. In certain embodiments, an enzyme with methane monooxygenase activity is pMMO or sMMO.

Assays for measuring MMO activity are known in the art. For example, a colorimetric naphthalene assay may be used to monitor sMMO activity (see, e.g., Brusseau et al., 1990, Biodegradation 1:19-29). Purified sMMO or cells grown in copper deficient media can oxidize naphthalene to a mixture of 1-naphthol and 2-naphthol, which are detected by reaction with tetrazotized o-dianisidine to form purple diazo dyes with large molecular absorptivities. sMMO and pMMO activity may be measured by monitoring the oxidation of propylene in whole cells, cell extracts, soluble fractions, or membrane fractions using gas chromatography (see, e.g., Prior and Dalton, 1985, J. Gen. Microbiol. 131:155-163; Dispirito et al., 1992, Biodegradation 2:151-164; Zahn and Dispirito, 1996, J. Bacteriol 178:1018-1029).

sMMO and pMMO genes from a number of methanotrophs have been sequenced and characterized (see, e.g., Stainthorpe et al., 1989, Arch. Microbiol. 152:154-159; Stainthorpe et al., 1990, Gene 91:27-34; Coufal et al., 2000, Eur. J. Biochem. 267:2174-2185; Cardy et al., 1991, Mol. Microbiol. 5:335-342; Cardy et al., 1991, Arch. Microbiol. 156:477-483; Semrau et al., 1995, J. Bacteriol. 177:3071-3079; Stolvar et al., 1999, Microbiol. 145:1235-1244; Gilbert et al., 2000, Appl. Environ. Microbiol. 66:966-975; Bodrossy et al., 1995, Applied Environ. Microbiol. 61:3549-3555; Bodrossy et al., 1999, FEMS Microbiol. Lett. 170: 335-341; Lin et al., 2005, Appl. Environ. Microbiol. 71:6458-6462; Hou et al. 2008, Biol. Direct. 3:26). Exemplary pMMO amino acid sequences that may be used in the non-naturally occurring microorganisms according to any of the embodiments disclosed herein are provided in SEQ ID NOS:1-643 and SEQ ID NOS:644-648.

In certain embodiments, an enzyme with methane monooxygenase activity is ammonia monooxygenase. Ammonia monooxygenase (AMO) is a membrane-bound enzyme expressed by nitrifying bacteria that catalyzes the oxidation of ammonia to hydroxylamine. AMO is a pMMO homolog that is also known to oxidize methane and other alkanes (up to $C_8$) to their corresponding alcohols (Hyman et al., 1988, Applied Environ. Microbiol. 54:3187-3190). The AMO operon consists of amoC, amoA, and amoB genes, with amoA containing the active site. AMO activity assays are known in the art (see, e.g., Moir et al., 1996, FEBS Lett. 387:71-74; Ensign et al., 1993, J. Bacteriol. 175:1971). AMO has been sequenced and characterized in a number of bacteria (see, e.g., McTavish et al., 1993, J. Bacteriol. 175:2436-2444; Norton et al., 2002, Arch. Microbiol. 177:139-149). Exemplary AMO amino acid sequences that may be used in the non-naturally occurring microorganisms according to any of the embodiments disclosed herein are provided in SEQ ID NOS:649-654.

In certain embodiments, an enzyme with methane monooxygenase activity is P450. P450, also known as cytochrome P450 or CYP, refers to a superfamily of enzymes that catalyze the oxidation of organic compounds. P450s have a broad range of substrates, including lipids, steroidal hormones, and xenobiotic substances. The most common reaction catalyzed by P450s is a monooxygenase reaction, where one atom of oxygen is inserted into an organic substrate (R—H) while the other oxygen atom is reduced to water. P450 enzymes have been found in a wide range of organisms, including animals, plants, fungi, bacteria (not including *E. coli*), and Archaea. Soluble cytochrome P450 from *Mycobacterium* sp. HXN-1500, CYP153A6, and *Bacillus megaterium*, CYP102A1 (BM3), have been shown to oxidize small alkanes into their corresponding alcohols, including methane for CYP153A6 (Chen et al., 2012, Protein Eng. Design Selection 25:171-178; Chen, Mike Ming Yu, 2011, *Directed evolution of cytochrome P450 for small alkane hydroxylation*. Dissertation (Ph.D.), California Institute of Technology). P450 activity may be assayed by measuring bioconversion of various alkanes into alcohols using gas chromatography-mass spectrometry (e.g., Kubota et al., 2005, Biosci. Biotechnol. Biochem. 69:2421-2430; Fujii et al., 2004, Biosci. Biotechnol. Biochem. 68:2171-2177). Numerous P450 genes have been sequenced and characterized (see, e.g., Nelson et al., 1996, Pharmacogenetics 6:1-42; Funhoff et al., 2006, J. Bacteriol. 188:5220-7; Kubota et al., 2005, Biosci. Biotechnol. Biochem. 69:2421-2430).

As described above, an enzyme with methane monooxygenase activity may comprise multiple components. In certain embodiments, a nucleic acid encoding an enzyme with methane monooxygenase activity may comprise polynucleotides encoding a gene cluster or operon for an enzyme with methane monooxygenase activity (e.g., all subunits of the enzyme), or for a single subunit that constitutes the active site for the enzyme. By way of example, where an enzyme with methane monooxygenase activity is pMMO, a nucleic acid may comprise polynucleotides comprising a pmoCAB gene cluster or a pmoA gene (β subunit). In another example, where an enzyme with methane monooxygenase activity is sMMO, a nucleic acid may comprise polynucleotides comprising a mmoXYZ gene cluster or a mmoX gene (a subunit).

The non-naturally occurring microorganisms of the present disclosure comprise an enzyme with methane monooxygenase activity is stable in the presence of a chemical or environmental stress, meaning that the enzyme retains substantial activity during exposure to a chemical or environmental stress (i.e., retains at least 25% catalytic activity under the stress condition as compared to without the stress condition). By way of example, an enzyme with MMO activity and a pre-existing stability in the presence of a chemical or environmental stress, e.g., a pMMO enzyme from a thermophilic methanotrophic bacteria with temperature stability at >60° C., may be selected for transformation into a host microorganism. The selected pMMO enzyme retains at least 25% of MMO activity at a temperature >60° C. as compared to normal temperature (e.g., 25°-30° C.). An enzyme with methane monooxygenase activity that is stable in the presence of a chemical or environmental stress may retain at least 25%, 30%, 35%, 40%, 45%, 50%, 55%, 60%, 65%, 70%, 75%, 80%, 85%, 90%, 95%, or 99% of catalytic activity under the stress condition as compared to without the stress condition.

In certain embodiments, nucleic acids encoding an enzyme with methane monooxygenase activity that naturally possess the desired stability in the presence of a chemical or environmental stress are used to transform non-naturally occurring microorganisms according to any of the embodiments disclosed herein. By way of example, thermophilic (e.g., Bodrossy et al., 1995, Applied Environ. Microbiol. 61:3549-3555), alkaliphilic (e.g., Lin et al., 2005, Appl. Environ. Microbiol. 71:6458-6462), and acidophilic (e.g., Hou et al., 2008, Biol. Direct 3:26) methanotrophic bacteria have been isolated. Nucleic acids encoding MMOs derived from a thermophilic, alkaliphilic, or acidophilic methanotrophic bacteria may be introduced into other microorganisms, including microorganisms that lack an MMO and methanotrophs that possess MMOs without the desired chemical or environmental stability, to provide an enzyme with methane monooxygenase activity and stability in the presence of high temperature, high pH, or low pH, respectively. Exemplary pMMO amino acid sequences from thermostable methanotrophic bacteria that may be used in the non-naturally occurring microorganisms of the present disclosure are provided in SEQ ID NOS: 644-648. Sources of nucleic acids encoding other enzymes with methane monooxygenase activity (e.g., AMO, P450) that naturally possess the desired stability in chemical or environmental stress (e.g., thermostability) may be microorganisms that exhibit the same chemical or environmental stability (e.g., thermostability). Exemplary AMO amino acid sequences from halotolerant bacteria (SEQ ID NOS:652, 653) and from a highly stress resistant bacteria (SEQ ID NO:654) that may be used in the non-naturally occurring microorganisms of the present disclosure are provided.

The non-naturally occurring microorganisms according to any of the embodiments disclosed herein may comprise an enzyme with catalytic activity that has been genetically engineered to be "stable" in the presence of a chemical or environmental stress, meaning that the engineered enzyme retains significant catalytic activity during exposure to a chemical or environmental stress as compared to a wild-type or reference enzyme exposed to the same stress condition (i.e., wild type or reference enzyme retains less than 25% catalytic activity during exposure to a stress condition than without the stress condition). A wild type or reference enzyme may retain 24%, 20%, 15%, 10%, 5% or less (<25%) catalytic activity during exposure to a stress condition than without the stress condition. Stability of enzymes with methane monooxygenase activity in the presence of a selected chemical or environmental stress may be measured using various activity assays known in the art.

Reference nucleic acids, also known as "wild type" or "parent" nucleic acids, encoding enzymes with methane monooxygenase activity are used as starting molecules for genetic engineering of variant enzymes with the desired stability. For example, a sMMO or pMMO encoding nucleic acid from a methanotrophic bacterium (e.g., *Methylosinus trichosporium* OB3b), which does not exhibit a particular stability in chemical or environmental stress, may be selected as a reference molecule for designing variant MMO enzymes with a selected chemical or environmental stress stability (e.g., temperature >60° C.). Exemplary reference pMMO amino acid sequences that may be genetically engineered are provided in SEQ ID NOS:1-643. Exemplary reference AMO amino acid sequences that may be genetically engineered are provided in SEQ ID NOs:649-654. The design of variants of enzymes with methane monooxygenase activity (e.g., pMMO) and nucleic acids encoding the same may be done using the phylogenetic-based methods described in, for example, U.S. Pat. No. 8,005,620 and Gustafsson (*Curr. Opin. Biotechnol.* 14:366, 2003; which methods are incorporated by reference) as well as Welch et al. (J. R. Soc. Interface. 6: S467, 2009), Villalobos et al. (*BMC Bioinformatics* 7: 285, 2006) Minshull et al. (*Curr. Opin. Chem. Biol.* 9:202, 2005), Gustafsson et al. (*Trends Biotechnol.* 22:346, 2004) and Minshull (*Methods* 32:416, 2004).

Endogenous enzymes with methane monooxygenase activity in host microorganisms (i.e., enzymes that are not stable in a chemical or environmental stress) may not need to be inactivated, and may be present in the non-naturally occurring microorganism along with introduced enzymes with methane monooxygenase activity that are stable in a chemical or environmental stress.

Each variant enzyme with methane monooxygenase activity that is generated by phylogenetic-based methods is a polypeptide that is at least 70%, 75%, 80%, 85%, or 90% identical (e.g., at least 91%, at least 92%, at least 93%, at least 94%, at least 95%, at least 96%, at least 97%, at least 98%, or at least 99% identical) to a reference or parental wild-type enzyme with methane monooxygenase activity. In certain embodiments, variant enzymes also contain at least one amino acid substitution (e.g., 1, 2, 3, 5, 6, 7, 8, 9 or 10 or more or up to 20 or 30 or more substitutions) at a pre-determined position relative to a reference or parental wild-type enzyme with methane monooxygenase activity, provided that the variant retains methane monooxygenase activity.

Non-naturally occurring microorganisms as described herein may be transformed to comprise at least one exogenous nucleic acid to provide the host organism with a new or enhanced activity (i.e., methane monooxygenase activity that is stable in presence of chemical or environmental stress) or may be genetically modified to remove or substantially reduce an endogenous gene function (e.g., methanol dehydrogenase activity) using a variety of methods known in the art. Recombinant methods for exogenous expression of nucleic acids in microbial organisms are well known in the art. Such methods can be found described in, for example, Sambrook et al., *Molecular Cloning: A Laboratory Manual*, Third Ed., Cold Spring Harbor Laboratory, New York (2001); and Ausubel et al., *Current Protocols in Molecular Biology*, John Wiley and Sons, Baltimore, Md. (1999). Expression of pMMO or sMMO in a heterologous host has been previously described (see., e.g., Jahng et al., 1996, Biotechnol. Bioeng. 51:349-59; Han et al., 2009, Sheng wu Gong Cheng Xue Bao 25:1151-9; Gou et al., 2006, 263:136-141; Ramakrishnan et al., 2010, Nature 465: 115-119).

While genetic engineering tools of methanotrophic bacteria are not as extensive as for other microorganisms (e.g., *E. coli*), significant advances have been made allowing genetic manipulation of methanotrophic bacteria, as summarized below.

Expression systems and expression vectors useful for the expression of heterologous nucleic acids in methanotrophic bacteria are known. Vectors or cassettes useful for the transformation of suitable host microorganisms are available.

Electroporation of methylotrophic bacteria has been previously described in Toyama et al., 1998, FEMS Microbiol. Lett. 166:1-7 (*Methylobacterium extorquens*); Kim and Wood, 1997, Appl. Microbiol. Biotechnol. 48:105-108 (*Methylophilus methylotrophus* AS1); Yoshida et al., 2001, Biotechnol. Lett. 23:787-791 (*Methylobacillus* sp. strain 12S), and US2008/0026005 (*Methylobacterium extorquens*).

Bacterial conjugation, which refers to a particular type of transformation involving direct contact of donor and recipient cells, is more frequently used for the transfer of nucleic acids into methanotrophic bacteria. Bacterial conjugation involves mixing "donor" and "recipient" cells together in close contact with each other. Conjugation occurs by formation of cytoplasmic connections between donor and recipient bacteria, with unidirectional transfer of newly synthesized donor nucleic acids into the recipient cells. A recipient in a conjugation reaction is any cell that can accept nucleic acids through horizontal transfer from a donor bacterium. A donor in a conjugation reaction is a bacterium that contains a conjugative plasmid, conjugative transposon, or mobilized plasmid. The physical transfer of the donor plasmid can occur through a self-transmissible plasmid or with the assistance of a "helper" plasmid. Conjugations involving methanotrophic bacteria have been previously described in Stolyar et al., 1995, Mikrobiologiya 64:686-691; Motoyama et al., 1994, Appl. Micro. Biotech. 42:67-72; Lloyd et al., 1999, Archives of Microbiology 171:364-370; and Odom et al., PCT Publication WO 02/18617; Ali et al., 2006, Microbiol. 152:2931-2942.

Expression of heterologous nucleic acid molecules in methanotrophic bacteria is known in the art (see, e.g., U.S. Pat. No. 6,818,424, U.S. Patent Publication 2003/0003528). Mu transposon based transformation of methylotrophic bacteria has been described (see, e.g., Akhverdyan et al., 2011, Appl. Microbiol. Biotechnol. 91:857-871). A mini-Tn7 transposon system for single and multicopy expression of heterologous genes without insertional inactivation of host genes in *Methylobacterium* has been described (see, e.g. U.S. Patent Publication 2008/0026005).

Various methods for inactivating, knocking-out, or deleting endogenous gene function in methanotrophic bacteria may be used. Allelic exchange using suicide vectors to construct deletion/insertional mutants in slow growing methanotrophic bacteria have also been described in Toyama and Lidstrom, 1998, Microbiol. 144:183-191; Stolyar et al., 1999, Microbiol. 145:1235-1244; Ali et al., 2006, Microbiology 152:2931-2942; Van Dien et al., 2003, Microbiol. 149:601-609.

Suitable homologous or heterologous promoters for high expression of exogenous nucleic acids may be utilized. For example, U.S. Pat. No. 7,098,005 describes the use of promoters that are highly expressed in the presence of methane or methanol for heterologous gene expression in methanotrophic bacteria. Additional promoters that may be used include deoxy-xylulose phosphate synthase methanol dehydrogenase operon promoter (Springer et al., 1998, FEMS Microbiol. Lett. 160:119-124); the promoter for PHA synthesis (Foellner et al. 1993, Appl. Microbiol. Biotechnol. 40:284-291); or promoters identified from native plasmid in methylotrophs (EP296484). Non-native promoters include the lac operon Plac promoter (Toyama et al., 1997, Microbiology 143:595-602) or a hybrid promoter such as Ptrc (Brosius et al., 1984, Gene 27:161-172). Regulation of expression of an exogenous nucleic acid molecule in the host C1 metabolizing organism may also be utilized. For example, an inducible/regulatable system of recombinant protein expression in methylotrophic and methanotrophic bacteria has been described in US Patent Publication 2010/0221813.

As provided herein, non-naturally occurring microorganisms also comprise at least one alcohol dehydrogenase (ADH) that is inactivated. As used herein, an alcohol dehydrogenase refers to any enzyme that catalyzes the reversible conversion of alcohols into their corresponding aldehydes or ketones with the reduction of $NAD^+$ to NADH. An alcohol dehydrogenase is inactivated if it possesses less than 25% activity as compared to a wild type or reference enzyme or possesses less than 25% activity during or after exposure to a chemical or environmental stress as compared to during normal conditions. For example, an inactivated ADH (e.g., genetically inactivated) may possess 24%, 20%, 15%, 10%, 5%, or 1% or less activity as compared to a wild type ADH. In another example, an inactivated ADH may possess 24%, 20%, 15%, 10%, 5%, or 1% or less activity during or after exposure to a chemical or environmental stress (e.g., heat>60° C.) as compared to without the chemical or environmental stress (e.g., at normal temperature). According to any of the embodiments disclosed herein, the at least one alcohol dehydrogenase includes methanol dehydrogenase. Methanol dehydrogenase (MDH) catalyzes the conversion of methanol to formaldehyde. ADH genes have been identified in a number of microorganisms (see, e.g., Harms et al., 1987, J. Bacteriol. 169:3969-3975; de Vries et al., 1992, J. Bacteriol. 174:5346-5353; Anderson et al., 1990, Gene 90:173-176; Anthony and Williams, 2003, Biochim. Biophys. Acta 1647:18-23; Ward et al., 2004, PLoS Biol. 2:e303; Bennetzen and Hall, 1982, J. Biol. Chem. 257:3018-3025; Reid and Fewson, 1994, Crit. Rev. Microbiol. 20:13-56).

Alcohol dehydrogenases may show broad or non-specific oxidation activity (see, e.g., Anthony and Zatman, 1965, Biochem. J. 96:808; Lu et al., 2010, J. Am. Chem. Soc. 132:15451-5). Alcohol or epoxide products, including methanol, produced by enzymes with methane monooxygenase activity may be oxidized further into unwanted products by endogenous alcohol dehydrogenases. Non-naturally occurring microorganisms provided herein may exhibit poor yields due to downstream metabolism of methanol, other alcohol products (e.g., ethanol, propanol, and butanol), or epoxides. By inactivating at least one alcohol dehydrogenase (e.g., methanol dehydrogenase), reduction of alcohol or epoxide product loss and improvement of product yield may be achieved. In further embodiments, provided are non-naturally occurring microorganisms where two, three, four, or more alcohol dehydrogenases are inactivated. By way of example, ADH sequences that may be inactivated in *Methylosinus trichosporium* OB3b, *Methylococcus capsulatus* str. Bath, and *Methylomicrobium alcaliphilum* 20Z are provided in SEQ ID NOS:655-665. Inactivation of an ADH may be confirmed by methods known in the art (see, e.g., Wadzinski and Ribbons, 1975, J. Bacteriol. 122:1364-1374; Frank et al., 1989, Eur. J. Biochem. 184:187-195; Guo and Lidstrom, 2006, Arch. Microbiol. 186:139-49; Anthony and Zatman, 1967, Biochem. J. 104:960-9; Kalyuzhnaya et al., 2008, J. Bacteriol. 190:3817-3823; Schmidt et al., 2010, Microbiol. 156:2575-2586).

In certain embodiments, an alcohol dehydrogenase is inactivated by genetic modification. Genetic methods for inactivating, knocking-out, or deleting endogenous gene function in microorganisms are well known in the art. For example, where sequence of the gene to be inactivated is known, targeted gene disruption, wherein foreign DNA is inserted into a structural gene in order to disrupt transcription, may be used. This may be accomplished with genetic cassettes comprising DNA inserts (e.g., genetic marker) flanked by sequence having a high degree of homology to a portion of the gene to be disrupted. Following introduction of the cassette into the host microorganism, native DNA replication mechanisms insert the foreign DNA into the structure gene (see, e.g., Hamilton et al., 1989, J. Bacteriol. 171:4617-4622; Balbas et al, 1993, Gene 136:211-213). Examples of gene disruption methods include transposon mutagenesis (e.g., Simon et al., 1983, Nature Biotechnol. 1:784-791; Hayes, 2003, Annual Rev. Genet. 37:3-29), intron insertion (e.g., Karberg et al., 2001, Nat. Biotechnol. 19:1162-7; Zhong et al., 2003, Nucleic Acids Res. 31:1656-64), targeted knockout using PCR fragments (e.g., Murphy, 2011, Methods Mol. Biol. 765:27-42; Baudin et al., 1993, Nucleic Acids Res. 21:3320-30); allelic exchange (e.g., Toyama and Lidstrom, 1998, Microbiol. 144:183-191; Stolyar et al., 1999, Microbiol. 145:1235-1244), and Cre-lox recombination knockout systems (e.g., Gueldener et al., 2002, Nucleic Acids Res. 30:e23; Pomerantsev et al., 2006, Infect. Immun. 74:682-693).

In certain embodiments, a chemical or environmental stress, in which the enzyme with methane monooxygenase activity is stable, inactivates an alcohol dehydrogenase. In further embodiments, an alcohol dehydrogenase is inactivated by chemical or environmental stress that is a temperature of at least 60° C., a pH of at least 9, or a pH of 5 or below. If a nucleic acid encoding an enzyme with methane monooxygenase activity is selected for stability in a particular chemical or environmental stress and introduced into a microorganism, exposure of the transformed microorganism to the particular chemical or environmental stress may be designed to retain MMO activity while inactivating at least one ADH (e.g., MDH). In some embodiments, a substantial amount or most of the endogenous enzymes of the microorganism are inactivated by a chemical or environmental stress, except for the enzyme with MMO activity. Use of the chemical or environmental stress to inactivate downstream alcohol (e.g., methanol) or epoxide metabolism enzymes circumvents the need to perform gene knock outs of ADHs and other non-specific enzymes to improve alcohol or epoxide production efficiency. By way of example, a non-naturally occurring microorganism may be transformed with an exogenous nucleic acid encoding an enzyme with MMO activity (e.g., pMMO) that is thermostable at >60° C. ADHs, including MDH, as well as most other endogenous enzymes in the microorganism are inactivated at this elevated temperature, which allows for efficient production of a desired alcohol (e.g., methanol). As oxidation of methane is highly exothermic, an additional advantage of increased thermal stability of an enzyme with MMO activity is that it allows for operation of a bioreactor at a higher temperature, improving cooling efficiency and reducing cost while simultaneously making the catalyst more tolerant of small local temperature excursions, which are likely to occur in a commercial scale reactor. Furthermore, enzymatic reactions often proceed more rapidly at higher temperatures, which may improve overall process yield.

In preferred embodiments, the selected host microorganism does not display the particular chemical or environmental stress stability that the enzyme with methane monooxygenase activity that is being introduced into the microorganism displays.

An environmental or chemical stress refers to conditions of that affect the ability of a microorganism to metabolize normally, survive, or the ability of a protein or enzyme (e.g., methanol dehydrogenase) of a microorganism to perform its function. Environmental stress conditions include temperature extremes (heat or cold), light availability, water availability, and oxygen concentration. Chemical stress conditions include increased metal concentration, pH stress (high acidity or alkalinity), increased salt concentration, exposure to chemicals, and low nutrient availability. By way of example, an environment stress may be a temperature of at least 40° C., at least 45° C., at least 50° C., at least 55° C., at least 60° C., at least 65° C., at least 70° C., at least 75° C., at least 80° C., at least 85° C., at least 90° C., or at least 95° C. In another example a chemical stress may be a pH of at least 8, at least 8.5, at least 9, at least 9.2, at least 9.4, at least 9.6, at least 9.8, or at least 10, or a pH up to 6, up to 5.5, up to 5, up to 4.8, up to 4.6, up to 4.4, up to 4.2, or up to 4. According to any of the embodiments disclosed herein, a chemical or environmental stress may be a temperature of at least 60° C., a pH of at least 9, or a pH of 5 or below.

The introduction of an exogenous nucleic acid encoding an enzyme with methane monooxygenase activity confers upon non-naturally occurring microorganisms as described herein the capability of converting methane into methanol. Due to the broad specificity of some enzymes with methane monooxygenase activity (e.g., sMMO and pMMO), non-naturally occurring microorganisms according to any of the embodiments disclosed herein may also be capable of converting ethane, propane, and butane into their corresponding alcohols, ethanol, propanol, and butanol, respectively, or converting ethylene, propylene, butene, and butadiene into their corresponding epoxides. In certain embodiments, butanol comprises substantially of n-butanol (i.e., n-butanol comprises at least 50% or more of the butanol product). In certain embodiments, propanol comprises substantially of n-propanol (i.e., n-propanol comprises at least 50% or more of the propanol product). In certain embodiments, non-naturally occurring microorganisms according to any of the embodiments disclosed herein are capable of converting a mixed alkane gas substrate into a mixed alcohol product. A mixed alkane gas substrate may be wet (unprocessed) natural gas or a partially separated derivative thereof (e.g., natural gas liquids separated from wet natural gas during processing). Natural gas liquids include ethane, propane, and butane. In certain embodiments, non-naturally occurring microorganisms according to any of the embodiments disclosed herein are capable of converting light alkanes (i.e., any combination of two or more alkanes selected from methane, ethane, propane, and butane) into their corresponding alcohols.

Non-naturally occurring microorganisms according to any of the embodiments disclosed herein may also be capable of converting ethylene, propylene, butene, butadiene into their corresponding epoxides, ethylene oxide, propylene oxide, butene oxide, and butadiene 1,2 oxide respectively. In certain embodiments, non-naturally occurring microorganisms according to any of the embodiments disclosed herein are capable of converting a mixed alkene gas substrate into a mixed epoxide product. A mixed alkene gas substrate may be a gas stream from a petroleum cracker or a partially separated derivative thereof. In certain embodiments, non-naturally occurring microorganisms according to any of the embodiments disclosed herein are capable of converting light alkenes (i.e., any combination of two or more alkenes selected from ethylene, butene, and butadiene) into their corresponding epoxides.

As noted in the present disclosure, an enzyme with methane monooxygenase activity uses a reducing agent, to catalyze oxidation of methane and other light alkanes to their corresponding alcohols or alkenes to their corresponding epoxides, and to regenerate the enzyme. The physiological reductant for sMMO is NADH. However, NADH or similar cofactors are less likely to be used in bioreactors. Enzymes with methane monooxygenase activity are known to use other reducing agents, such as quinols (e.g., duroquinol), formate, or $H_2$ (Shiemke et al., 1995, Arch. Biochem. Biophys. 321:421-8; Shiemke et al., 2004, J. Bacteriol. 186-928-937; Patel et al., 1982, Appl. Environ. Microbiol. 44:1130-1137; Hanczar et al., 2002, Arch. Microbiol. 177: 167-172). In certain embodiments, non-naturally occurring microorganisms according to any of the embodiments disclosed herein are capable of utilizing $H_2$ as a reducing agent for converting methane into methanol. In further embodiments, exogenous nucleic acids encoding an enzyme with methane monooxygenase activity have been genetically modified using phylogenetic based methods described herein to be capable of directly utilizing $H_2$ as a reducing agent (i.e., without any accessory proteins such as a hydrogenase). In other embodiments, non-naturally occurring microorganisms according to any of the embodiments disclosed herein comprise a nucleic acid (exogenous or endogenous) encoding a hydrogenase enzyme enabling use of $H_2$ as a reducing agent. A hydrogenase enzyme catalyzes the reversible oxidation of molecular hydrogen, and may be needed for hydrogen-driven MMO activity. Use of $H_2$ as a reducing agent for MMO activity may allow for better control of heat generation, as methane oxidation may occur as two exothermic half reactions (see FIG. 1) that can be performed sequentially, rather than simultaneously (i.e., $CH_4+O_2+H_2 \rightarrow H_2O+CH_3OH$). Secondly, generation of water byproduct may proceed independently of methanol production, thereby reducing the need for costly methanol distillation.

With the complete genome sequence available for hundreds of microorganisms, the identification of genes encoding an enzyme with methane monooxygenase activity or an alcohol dehydrogenase in related or distant species, including for example, homologs, orthologs, paralogs, etc., is routine and well known in the art. Accordingly, exogenous nucleic acids encoding an enzyme with methane monooxygenase activity described herein with reference to particular nucleic acids from a particular microorganism can readily include other nucleic acids encoding an enzyme with methane monooxygenase activity from other microorganisms. Furthermore, identification of alcohol dehydrogenases to be inactivated in a host microorganism may be identified by similarity of host microorganism sequences to known alcohol dehydrogenase proteins in homologous or heterologous microorganisms.

Polypeptide sequences and encoding nucleic acids for proteins, protein domains, and fragments thereof described herein, such as an enzyme with methane monooxygenase activity or an alcohol dehydrogenase, may include natural and recombinantly engineered variants. A nucleic acid variant refers to a nucleic acid that may contain one or more substitutions, additions, deletions, insertions, or may be or comprise fragment(s) of a reference nucleic acid. A reference nucleic acid refers to a selected wild-type or parent nucleic acid encoding an enzyme with methane monooxygenase activity. A variant nucleic acid may have 40%, 45%, 50%, 55%, 60%, 65%, 70%, 75%, 80%, 85%, 90%, 95%, 96%, 97%, 98%, or 99% sequence identity to a reference nucleic acid, as long as the variant nucleic acid encodes a polypeptide that can still perform its requisite function or biological activity (e.g., oxidizing methane into methanol). A variant polypeptide may have 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% sequence identity to a reference protein, as long as the variant polypeptide can still perform its requisite function or biological activity (e.g., oxidizing methane into methanol). In certain embodiments, an enzyme with methane monooxygenase activity that is introduced into non-naturally occurring microorganisms according to any of the embodiments disclosed herein comprises an amino acid sequence having at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity to an amino acid sequence selected from SEQ ID NOS: 1-643, SEQ ID NOS: 644-648, and SEQ ID NOS: 649-654. In certain embodiments, an alcohol dehydrogenase enzyme that is inactivated in a non-naturally occurring microorganism according to any of the embodiments disclosed herein comprises an amino acid sequence having at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity to an amino acid sequence selected from SEQ ID NOs: 655-665. These variants may have improved function and biological activity (e.g., higher enzymatic activity or improved specificity for substrate) than the parent (or wildtype) protein. Due to redundancy in the genetic code, nucleic acid variants may or may not affect amino acid sequence. A nucleic acid variant may also encode an amino acid sequence comprising one or more conservative substitutions compared to a reference amino acid sequence. A conservative substitution may occur naturally in the polypeptide (e.g., naturally occurring genetic variants) or may be introduced when the polypeptide is recombinantly produced. A conservative substitution is where one amino acid is substituted for another amino acid that has similar properties, such that one skilled in the art would expect that the secondary structure and hydropathic nature of the polypeptide to be substantially unchanged. Amino acid substitutions may generally be made on the basis of similarity in polarity, charge, solubility, hydrophobicity, and/or the amphipathic nature of the residues, and is known in the art. Amino acid substitutions, deletions, and additions may be introduced into a polypeptide using well-known and routinely practiced mutagenesis methods (see, e.g., Sambrook et al. *Molecular Cloning: A Laboratory Manual,* 3d ed., Cold Spring Harbor Laboratory Press, NY 2001). Oligonucleotide-directed site-specific (or segment specific) mutagenesis procedures may be employed to provide an altered polynucleotide that has particular codons altered according to the substitution, deletion, or insertion desired. Deletion or truncation variants of proteins may also be constructed by using convenient restriction endonuclease sites adjacent to the desired deletion. Alternatively, random mutagenesis techniques, such as alanine scanning mutagenesis, error prone polymerase chain reaction mutagenesis, and oligonucleotide-directed mutagenesis may be used to prepare polypeptide variants (see, e.g., Sambrook et al., supra).

Nucleic acids encoding an enzyme with methane monooxygenase activity may be combined with other nucleic acid sequences, such as promoters, polyadenylation signals, restriction enzyme sites, multiple cloning sites, other coding segments, and the like.

Differences between a wild type (or parent) nucleic acid or polypeptide and the variant thereof, may be determined by methods routinely practiced in the art to determine identity, which are designed to give the greatest match between the sequences tested. Methods to determine sequence identity can be applied from publicly available computer programs. Computer program methods to determine identity between two sequences include, for example, BLASTP, BLASTN (Altschul, S. F. et al., *J. Mol. Biol.* 215: 403-410 (1990), and FASTA (Pearson and Lipman Proc. Natl. Acad. Sci. USA 85; 2444-2448 (1988). The BLAST family of programs is publicly available from NCBI and other sources (*BLAST Manual,* Altschul, S., et al., NCBI NLM NIH Bethesda, Md.

Assays for determining whether a polypeptide variant folds into a conformation comparable to the non-variant polypeptide or fragment include, for example, the ability of the protein to react with mono- or polyclonal antibodies that are specific for native or unfolded epitopes, the retention of ligand-binding functions, the retention of enzymatic activity (if applicable), and the sensitivity or resistance of the mutant protein to digestion with proteases (see Sambrook et al., supra). Polypeptides, variants and fragments thereof, can be prepared without altering a biological activity of the resulting protein molecule (i.e., without altering one or more functional activities in a statistically significant or biologically significant manner). For example, such substitutions are generally made by interchanging an amino acid with another amino acid that is included within the same group, such as the group of polar residues, charged residues, hydrophobic residues, and/or small residues, and the like. The effect of any amino acid substitution may be determined empirically merely by testing the resulting modified protein for the ability to function in a biological assay, or to bind to a cognate ligand or target molecule.

Codon Optimization

Expression of recombinant proteins is often difficult outside their original host. For example, variation in codon usage bias has been observed across different species of bacteria (Sharp et al., 2005, Nucl. Acids. Res. 33:1141-1153). Over-expression of recombinant proteins even within their native host may also be difficult. In certain embodiments of the invention, nucleic acids (e.g., a nucleic acid encoding an enzyme with methane monooxygenase activity that is stable in the presence of a chemical or environmental stress) that are to be introduced into microorganisms according to any of the embodiments disclosed herein may undergo codon optimization to enhance protein expression. Codon optimization refers to alteration of codons in genes or coding regions of nucleic acids for transformation of an organism to reflect the typical codon usage of the host organism without altering the polypeptide for which the DNA encodes. Codon optimization methods for optimum gene expression in heterologous organisms are known in the art and have been previously described (see., e.g., Welch et al., 2009, PLoS One 4:e7002; Gustafsson et al., 2004, Trends Biotechnol. 22:346-353; Wu et al., 2007, Nucl. Acids Res. 35:D76-79; Villalobos et al., 2006, BMC Bioinformatics 7:285; U.S. Patent Publication 2011/0111413; and U.S. Patent Publication 2008/0292918).

Methods of Oxidizing Hydrocarbons Using Non-Naturally Occurring Microorganisms

In certain embodiments, provided are methods of converting methane into methanol, the method comprising: providing a non-naturally occurring microorganism according to any of the embodiments disclosed herein or a cell-free fraction derived thereof; exposing the non-naturally occurring microorganism to $O_2$; a gas substrate comprising methane; and a reducing agent; wherein the methane gas is converted to methanol. Non-naturally occurring microorganisms according to any of the embodiments disclosed herein may be provided as living whole cells (e.g., in culture, on a biofilm, or as a moist cell paste), non-living whole cells (e.g., lyophilized whole cell preparations, reconstituted whole cell preparations of lyophilized cells), or cell-free fractions derived thereof (e.g., membrane fractions). Methane monooxygenase activity may be separated from whole cells by association with a particular organelle, allowing use of cell-free fractions resulting from differential centrifugation. (see, e.g., Nguyen et al., 1994, J. Biol. Chem. 269: 14995-15005; Scott and Higgins, 1981, Microbiol. 125:63-72). Cell-free fractions may include cell lysates and soluble or membrane fractions of centrifuged cell-free extracts. Cell-free fractions may also include protein extracts containing an enzyme with MMO activity, such as detergent-solubilized fractions (see, e.g., Smith and Dalton, 1989, Eur. J. Biochem. 182:667-671) or purified enzyme (see., e.g., Lieberman et al., 2003, Proc. Natl. Acad. Sci. USA 100: 3820-3825). Whole cells and cell-free fractions may be provided in a substantially non-aqueous state (e.g., lyophilized). Lyophilized preparations of enzymes with MMO activity (e.g., pMMO) have been shown to retain catalytic activity (see, e.g., U.S. Patent Publication 2002/0168733; Nguyen et al., 1994, J. Biol. Chem. 269:14995-15005).

In certain embodiments, non-naturally occurring microorganisms are methanotrophic bacteria. In certain embodiments, the enzyme with methane monooxygenase activity is pMMO, sMMO, ammonia monooxygenase, or P450. In further embodiments, the pMMO enzyme comprises an amino acid sequence as provided by SEQ ID NOS:644-648 or a genetically engineered stable variant of an amino acid sequence provided by SEQ ID NOS:1-643. In further embodiments, the AMO enzyme comprises an amino acid sequence selected from SEQ ID NOS:652-654 or a genetically engineered stable variant of an amino acid sequence comprising any one of SEQ ID NOS:649-651.

In certain embodiments, methods for converting methane into methanol using the non-naturally occurring microorganisms according to any of the embodiments disclosed herein or cell-free fraction derived thereof is performed under a chemical or environmental stress. In further embodiments, the chemical or environmental stress is a temperature of at least 60° C., a pH of at least 9, or a pH of 5 or below. A chemical of environmental stress may be a temperature of at least 40° C., at least 45° C., at least 50° C., at least 55° C., at least 60° C., at least 65° C., at least 70° C., at least 75° C., at least 80° C., at least 85° C., at least 90° C., or at least 95° C. In another example a chemical stress may be a pH of at least 8, at least 8.5, at least 9, at least 9.2, at least 9.4, at least 9.6, at least 9.8, at least 10 or a pH up to 6, up to 5.5, up to 5, up to 4.8, up to 4.6, up to 4.4, up to 4.2, up to 4.

In certain embodiments, the alcohol dehydrogenase is inactivated by the chemical or environmental stress. In some embodiments, the alcohol dehydrogenase is inactivated by a chemical or environmental stress that is a temperature >60° C., a pH>9, or a pH<5. Alternatively, the alcohol dehydrogenase may be inactivated by genetic modification. The at least one alcohol dehydrogenase that is inactivated in the non-naturally occurring microorganism may include methanol dehydrogenase. Exemplary amino acid sequences for alcohol dehydrogenases in methanotrophic bacteria that may be inactivated are provided by SEQ ID NOS:655-665.

Non-naturally occurring microorganisms according to any of the embodiments disclosed herein or cell-free fractions derived thereof are exposed to a gas substrate comprising methane, which provides a methane substrate for conversion into methanol. A gas substrate comprising methane may be a substantially purified form, such as pipeline quality natural gas. In certain embodiments, a gas substrate comprising methane is a mixture of gases, such as wet natural gas. A gas mixture may comprise light alkanes (e.g., any combination of two or more alkanes selected from the group consisting of methane, ethane, propane, and butane).

Dioxygen ($O_2$) is provided as an oxidant, where one oxygen atom is reduced to form $H_2O$, while the other is incorporated into methane to form methanol. The source of $O_2$ may be air, pure $O_2$, or a synthetic gas mixture comprising $O_2$ (e.g., mixture of $O_2$ and $N_2$). In certain embodiments, $O_2$ is mixed with the gas substrate comprising methane. Gaseous $O_2$ may be mixed with the gas substrate prior to injection into a bioreactor housing non-naturally occurring microorganisms or cell-free fractions derived thereof, or the gases may be injected into the bioreactor at the same time but separately, with mixing to occur during passage through the bioreactor. Alternatively, $O_2$ is provided to the non-naturally occurring microorganisms or cell-free fractions derived thereof prior to the gas substrate comprising methane. In certain embodiments where $O_2$ is provided prior to the gas substrate comprising methane, $O_2$ feed into the bioreactor may continue after introduction of the gas substrate into the bioreactor or may cease upon addition or prior to addition of the gas substrate. In certain embodiments where $O_2$ is provided prior to the gas substrate comprising methane, the non-naturally occurring microorganisms or cell-free fractions derived thereof are exposed to $O_2$ for a sufficient amount of time such that a substantial fraction of the enzymes with MMO activity have activated dioxygen.

A reducing agent is provided for powering methane oxidation and regenerating an enzyme with methane monooxygenase activity and may be any reducing agent that is capable of driving methane monooxygenase activity, including, for example, $H_2$, formate, and quinols. In certain embodiments, $H_2$ gas is utilized as the reducing agent. In further embodiments, $H_2$ gas is provided to the non-naturally occurring microorganisms or cell-free fractions derived thereof mixed with a gas substrate comprising methane. Gaseous $H_2$ may be mixed with the gas substrate prior to injection into a bioreactor housing non-naturally occurring microorganisms or cell-free fractions derived thereof, or the gases may be injected into the bioreactor at the same time but separately, with mixing to occur during passage through the bioreactor. Alternatively, $H_2$ gas is provided to the non-naturally occurring microorganisms or cell-free fractions derived thereof sequentially, following the gas substrate comprising methane. In certain embodiments where $H_2$ is provided after the gas substrate comprising methane, gas substrate feed into the bioreactor may continue after introduction of the $H_2$ into the bioreactor or may cease upon addition or prior to addition of $H_2$. In certain embodiments where $H_2$ is provided after the gas substrate comprising methane, the non-naturally occurring microorganisms or cell-free fractions derived thereof are exposed to the gas substrate comprising methane for a sufficient amount of time such that a substantial fraction of the enzymes with MMO activity have oxidized methane and are locked in an oxygen-bound state. Sequential addition of the gas substrate comprising methane and $H_2$ gas may separate methane oxidation reaction into two catalytic steps (see FIG. 1), allowing for better heat control of the bioreactor.

In certain embodiments, the reducing agent is formate.

In certain embodiments, methods described herein use non-naturally occurring microorganisms according to any of the embodiments disclosed herein or cell-free fractions derived thereof immobilized on, within, or behind a solid matrix. In further embodiments, the non-naturally occurring microorganisms or cell-free extracts derived thereof are in a substantially non-aqueous state (e.g., lyophilized). Non-naturally occurring microorganisms or cell-free fractions derived thereof are temporarily or permanently attached on, within, or behind a solid matrix within a bioreactor. Nutrients, substrates, and other required factors are supplied to the solid matrices so that the cells may catalyze desired reactions. Non-naturally occurring microorganisms may grow on the surface of a solid matrix (e.g., as a biofilm). Non-naturally occurring microorganisms or cell-free fractions derived thereof may be attached on the surface or within a solid matrix without cellular growth or in a non-living state. Exemplary solid matrix supports for microorganisms include polypropylene rings, ceramic bio-rings, ceramic saddles, fibrous supports (e.g., membrane), porous glass beads, polymer beads, charcoal, activated carbon, dried silica gel, particulate alumina, Ottawa sand, clay, polyurethane cell support sheets, and fluidized bed particle carrier (e.g., sand, granular-activated carbon, diatomaceous earth, calcium alginate gel beads).

Non-naturally occurring methanotrophic bacteria may be cultured using a variety of methods known in the art. In certain embodiments, the cultures are grown in a controlled culture unit, such as a fermentor, bioreactor, hollow fiber membrane bioreactor, packed bed bioreactor, or the like. A classical batch culturing method is a closed system where the composition of the media is set at the beginning of the culture and not subject to external alterations during the culture process. Thus, at the beginning of the culturing process, the media is inoculated with the desired organism or organisms and growth or metabolic activity is permitted to occur without adding anything to the system. Typically, however, a "batch" culture is batch with respect to the addition of carbon source and attempts are often made at controlling factors such as pH and oxygen concentration. In batch systems, the metabolite and biomass compositions of the system change constantly up to the time the culture is terminated. Within batch cultures, cells moderate through a static lag phase to a high growth logarithmic phase and finally to a stationary phase where growth rate is diminished or halted. If untreated, cells in the stationary phase will eventually die. Cells in log phase are often responsible for the bulk production of end product or intermediate in some systems. Stationary or post-exponential phase production can be obtained in other systems.

The Fed-Batch system is a variation on the standard batch system. Fed-Batch culture processes comprise a typical batch system with the modification that the substrate is added in increments as the culture progresses. Fed-Batch systems are useful when catabolite repression is apt to inhibit the metabolism of the cells and where it is desirable to have limited amounts of substrate in the media. Measurement of the actual substrate concentration in Fed-Batch systems is difficult and is therefore estimated on the basis of the changes of measureable factors, such as pH, dissolved oxygen, and the partial pressure of waste gases such as $CO_2$. Batch and Fed-Batch culturing methods are common and known in the art (see, e.g., Thomas D. Brock, Biotechnology: A Textbook of Industrial Microbiology, $2^{nd}$ Ed. (1989) Sinauer Associates, Inc., Sunderland, Mass.; Deshpande, 1992, Appl. Biochem. Biotechnol. 36:227, herein incorporated by reference).

Continuous cultures are "open" systems where a defined culture media is added continuously to a bioreactor and an equal amount of conditioned media is removed simultaneously for processing. Continuous cultures generally maintain the cells at a constant high liquid phase density where cells are primarily in logarithmic phase growth. Alternatively, continuous culture may be practiced with immobilized cells where carbon and nutrients are continuously added and valuable products, by-products, and waste products are continuously removed from the cell mass. Cell immobilization may be performed using a wide range of solid supports composed of natural and/or synthetic materials.

Continuous or semi-continuous culture allows for the modulation of one factor or any number of factors that affect cell growth or end product concentration. For example, one method will maintain a limited nutrient, such as the carbon source or nitrogen level, at a fixed rate and allow all other parameters to modulate. In other systems, a number of factors affecting growth can be altered continuously while the cell concentration, measured by media turbidity, is kept constant. Continuous systems strive to maintain steady state growth conditions and thus the cell loss due to media being drawn off must be balanced against the cell growth rate in the culture. Methods of modulating nutrients and growth factors for continuous culture processes, as well as techniques for maximizing the rate of product formation, are well known in the art, and a variety of methods are detailed by Brock, supra.

Liquid phase bioreactors (e.g., stirred tank, packed bed, one liquid phase, two liquid phase, hollow fiber membrane) are well known in the art and may be used for growth of non-naturally occurring microorganisms according to any of the embodiments disclosed herein and biocatalysis. However, the relatively low solubility of methane and other hydrocarbons in water may limit the catalytic rate of enzymes with methane monooxygenase activity.

By using gas phase bioreactors, substrates for biocatalysis or bioremediation are absorbed from a gas by non-naturally occurring microorganisms according to any of the embodiments disclosed herein or cell-free fractions derived thereof, rather than from a liquid. Use of gas phase bioreactors with microorganisms is known in the art (e.g., U.S. Pat. Nos. 2,793,096; 4,999,302; 5,585,266; 5,079,168; U.S. Statutory Invention Registration H1430; U.S. Patent Publication 2003/0032170; *Emerging Technologies in Hazardous Waste Management III*, 1993, eds. Tedder and Pohland, pp 411-428; U.S. Pat. No. 6,143,556). Exemplary gas phase bioreactors include single pass system, closed loop pumping system, and fluidized bed reactor. By utilizing gas phase bioreactors, methane or other gaseous substrates is readily available for biocatalysis by enzymes with methane monooxygenase activity. Furthermore, distillation of methanol product from aqueous solution, which represents a significant cost in liquid phase bioreactors, may be bypassed in gas phase bioreactors. In certain embodiments, methods according to any of the embodiments disclosed herein are performed in gas phase bioreactors. In certain embodiments, methods according to any of the embodiments disclosed herein are performed in fluidized bed reactors. In a fluidized bed reactor, a fluid (i.e., gas or liquid) is passed upward through particle bed carriers, usually sand, granular-activated carbon, or diatomaceous earth, on which microorganisms can attach and grow. The fluid velocity is such that particle bed carriers and attached microorganisms are suspended (i.e., bed fluidization). The microorganisms attached to the particle bed carriers freely circulate in the fluid, allowing for effective mass transfer of substrates in the fluid to the microorganisms and increased microbial growth. Exemplary fluidized bed reactors include plug-flow reactors and completely mixed reactors. Uses of fluidized bed reactors with microbial biofilms are known in the art (e.g., Pfluger et al., 2011, Bioresource Technology 102:9919-9926; Fennell et al. 1992, Biotechnology and Bioengineering 40:1218-1232; Ruggeri et al., 1994, Water Science Technology 29:347-351; U.S. Pat. Nos. 4,032,407; 4,009,098; 4,009,105; and U.S. Pat. No. 3,846,289).

Methanotrophic bacteria provided in the present disclosure may be grown as an isolated pure culture, with a heterologous non-methanotrophic organism(s) that may aid with growth, or with one or more different strains/or species of methanotrophic bacteria may be combined to generate a mixed culture.

As noted in the present disclosure, enzymes with methane monooxygenase activity may have broad substrate specificity and may oxidize other light alkanes, including ethane, propane, and butane into their corresponding alcohols and light alkenes, including ethylene, propylene, butene, and butadiene, into their corresponding epoxides. Accordingly, the non-naturally occurring microorganisms and methods for converting methane into methanol according to any of the embodiments disclosed herein may similarly be applied to methods for converting: ethane into ethanol, propane into propanol, butane into butanol, a mixed alkane gas substrate comprising light alkanes into a mixed alcohol product, ethylene into ethylene oxide, propylene into propylene oxide, butene into butene oxide, or a mixed alkene gas substrate comprising light alkenes into a mixed epoxide product.

In certain embodiments, provided are methods for converting ethane into ethanol, the method comprising: providing non-naturally occurring microorganisms according to any of the embodiments disclosed herein or a cell-free fraction derived thereof; exposing the non-naturally occurring microorganisms to $O_2$; a gas substrate comprising ethane; and a reducing agent; wherein the ethane gas is converted to ethanol.

In certain embodiments, provided are methods for converting propane into propanol, the method comprising: providing non-naturally occurring microorganisms according to any of the embodiments disclosed herein or a cell-free fraction derived thereof; exposing the non-naturally occurring microorganisms to $O_2$; a gas substrate comprising propane; and a reducing agent; wherein the propane gas is converted to propanol. In further embodiments, propanol substantially comprises n-propanol.

In certain embodiments, provided are methods for converting butane into butanol, the method comprising: providing non-naturally occurring microorganisms according to any of the embodiments disclosed herein or a cell-free fraction derived thereof; exposing the non-naturally occurring microorganisms to $O_2$; a gas substrate comprising butane; and a reducing agent; wherein the butane gas is converted to butanol. In further embodiments, butanol substantially comprises n-butanol.

In certain embodiments, provided are methods for converting a mixed alkane gas substrate into a mixed alcohol product, the method comprising: providing non-naturally occurring microorganisms according to any of the embodiments disclosed herein or a cell-free fraction derived thereof; exposing the non-naturally occurring microorganisms to $O_2$; a mixed gas substrate comprising light alkanes; and a reducing agent; wherein the light alkanes are converted into the corresponding alcohols. A mixed gas substrate comprising light alkanes may comprise two or more alkanes from the group consisting of: methane, ethane, propane, and butane.

In certain embodiments, methods for converting methane into methanol provided by the present disclosure oxidize at least 1, 5, 10, 30, 50, 70, 90, 100, 150, 200, 250, 300, 500 nmol methane/min/mg catalyst (e.g., whole cells or cell-free extract) dry weight at ambient temperature and pressure. In certain embodiments, methods for converting methane into methanol provided herein produce >1 L, >10 L, >100 L, >1000 L, >10000 L, or >50000 L methanol/day.

In certain embodiments, methods for converting ethane into ethanol provided by the present disclosure oxidize at least 1, 5, 10, 30, 50, 70, 90, 100, 150, 200, 250, 300, 500 nmol ethane/min/mg catalyst (e.g., whole cells or cell-free extract) dry weight at ambient temperature and pressure. In certain embodiments, methods for converting ethane into ethanol provided herein produce >1 L, >10 L, >100 L, >1000 L, >10000 L, or >50000 L ethanol/day.

In certain embodiments, methods for converting propane into propanol provided by the present disclosure oxidize at least 1, 5, 10, 30, 50, 70, 90, 100, 150, 200, 250, 300, 500 nmol propane/min/mg catalyst (e.g., whole cells or cell-free extract) dry weight at ambient temperature and pressure. In certain embodiments, methods for converting propane into propanol provided herein produce >1 L, >10 L, >100 L, >1000 L, >10000 L, or >50000 L propanol/day.

In certain embodiments, methods for converting butane into butanol provided by the present disclosure oxidize at least 1, 5, 10, 30, 50, 70, 90, 100, 150, 200, 250, 300, 500 nmol butane/min/mg catalyst (e.g., whole cells or cell-free extract) dry weight at ambient temperature and pressure. In certain embodiments, methods for converting butane into butanol provided herein produce >1 L, >10 L, >100 L, >1000 L, >10000 L, or >50000 L butanol/day.

In certain embodiments, provided are methods for converting ethylene into ethylene oxide, the method comprising: providing non-naturally occurring microorganisms according to any of the embodiments disclosed herein or a cell-free fraction derived thereof; exposing the non-naturally occurring microorganisms to $O_2$; a gas substrate comprising ethylene; and a reducing agent; wherein the ethylene gas is converted to ethylene oxide.

In certain embodiments, provided are methods for converting propylene into propylene oxide, the method comprising: providing non-naturally occurring microorganisms according to any of the embodiments disclosed herein or a cell-free fraction derived thereof; exposing the non-naturally occurring microorganisms to $O_2$; a gas substrate comprising propylene; and a reducing agent; wherein the propylene gas is converted to propylene oxide. In further embodiments, propylene oxide substantially comprises n-propylene oxide.

In certain embodiments, provided are methods for converting butene into butene oxide, the method comprising: providing non-naturally occurring microorganisms according to any of the embodiments disclosed herein or a cell-free fraction derived thereof; exposing the non-naturally occurring microorganisms to $O_2$; a gas substrate comprising butene; and a reducing agent; wherein the butene gas is converted to butene oxide. In further embodiments, butene oxide substantially comprises n-butene oxide.

In certain embodiments, provided are methods for converting butadiene into an epoxide product comprising butadiene 1,2 oxide.

In certain embodiments, provided are methods for converting a mixed alkene gas substrate into a mixed epoxide product, the method comprising: providing non-naturally occurring microorganisms according to any of the embodiments disclosed herein or a cell-free fraction derived thereof; exposing the non-naturally occurring microorganisms to $O_2$; a mixed gas substrate comprising light alkenes; and a reducing agent; wherein the light alkenes are converted into the corresponding epoxides. A mixed gas substrate comprising light alkenes may comprise two or more alkenes from the group consisting of: ethylene, propylene, butene, and butadiene.

In certain embodiments, methods for converting ethane into ethylene provided by the present disclosure oxidize at least 1, 5, 10, 30, 50, 70, 90, 100, 150, 200, 250, 300, 500 nmol ethylene/min/mg catalyst (e.g., whole cells or cell-free extract) dry weight at ambient temperature and pressure. In certain embodiments, methods for converting ethylene into ethylene oxide provided herein produce >1 L, >10 L, >100 L, >1000 L, >10000 L, or >50000 L ethylene oxide/day.

In certain embodiments, methods for converting propylene into propylene oxide provided by the present disclosure oxidize at least 1, 5, 10, 30, 50, 70, 90, 100, 150, 200, 250, 300, 500 nmol propylene/min/mg catalyst (e.g., whole cells or cell-free extract) dry weight at ambient temperature and pressure. In certain embodiments, methods for converting propylene into propylene oxide provided herein produce >1 L, >10 L, >100 L, >1000 L, >10000 L, or >50000 L propylene oxide/day.

In certain embodiments, methods for converting butene into butene oxide provided by the present disclosure oxidize at least 1, 5, 10, 30, 50, 70, 90, 100, 150, 200, 250, 300, 500 nmol butene/min/mg catalyst (e.g., whole cells or cell-free extract) dry weight at ambient temperature and pressure. In certain embodiments, methods for converting butene into butene oxide provided herein produce >1 L, >10 L, >100 L, >1000 L, >10000 L, or >50000 L butene oxide/day.

It is understood that the methods according to any of the embodiments disclosed herein may use a gas substrate comprising any combination of two or more light alkanes (e.g., methane, ethane, propane, and butane) and light alkenes (e.g., ethylene, propylene, butene, and butadiene). For example, a gas substrate may comprise only alkanes, only alkenes, or a combination of both.

Systems for Oxidizing Hydrocarbons

Figure 2:
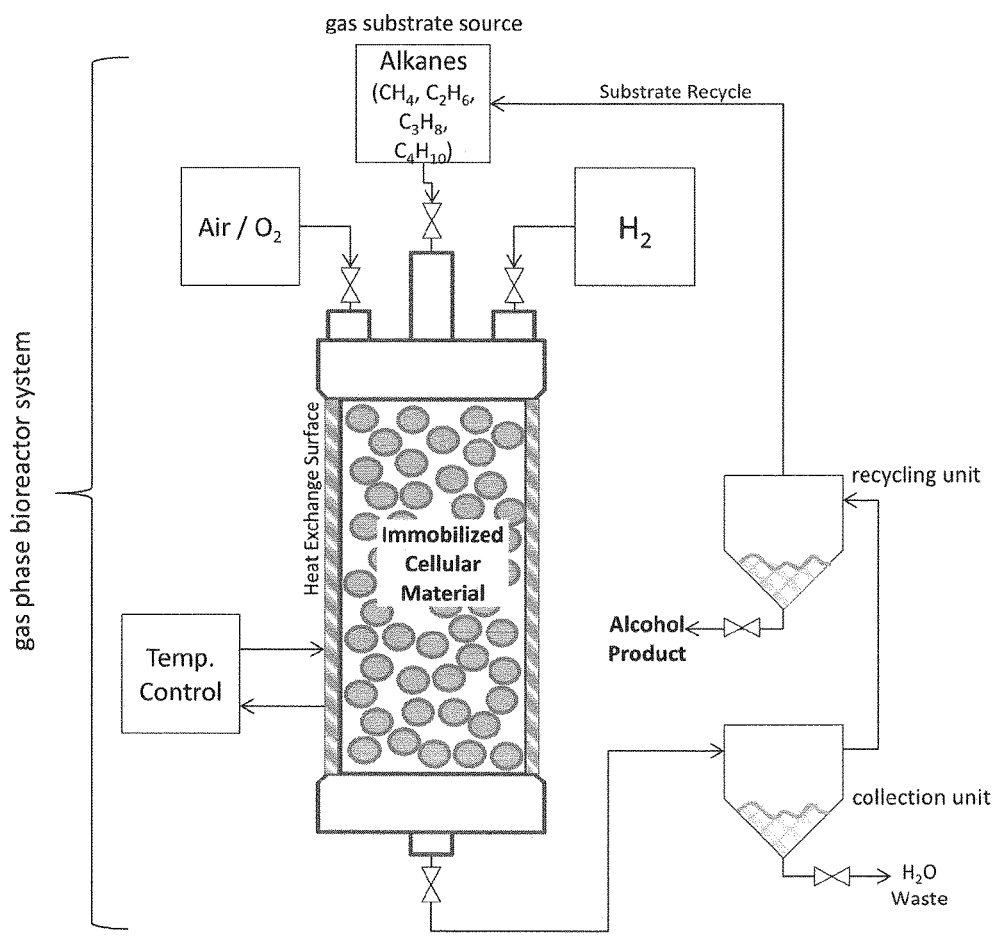
FIG. 2 shows an exemplary system comprising a gas phase bioreactor for converting alkane substrates into their associated alcohols containing immobilized non-naturally occurring microorganisms cellular material; air/$O_2$ source and connector; gas substrate source and connector; $H_2$ source and connector; a chemical or environmental control unit (e.g., temperature); a collection unit (optionally including a condenser and/or distillation unit); and a recycling unit.

In certain embodiments, provided are systems for converting alkanes into alcohols or alkenes into epoxides comprising: a gas phase bioreactor comprising non-naturally occurring microorganisms according to any of the embodiments disclosed herein or cell-free fractions derived thereof immobilized on a solid matrix; a connector for conveying a gas substrate comprising at least one light alkane or alkene from a gas source into the bioreactor; wherein the gas substrate is passed in close proximity to the non-naturally occurring microorganisms or cell-free fractions derived thereof such that the microorganism or cell-free fractions oxidize the light alkane into a corresponding alcohol product or the alkene into a corresponding epoxide product. An exemplary system is provided in FIG. 2. Systems comprising gas phase reactors, connectors, gas sources, condensers, distillation units, and recycling units for catalytic conversion of methane to methanol, other alkane conversions, and conversion of alkenes into epoxides are well known in the art, and may be adapted for gas phase bioreactors.

In certain embodiments, the systems for converting oxidizing hydrocarbons further comprises a chemical or environmental control unit, capable for maintaining a chemical or environmental stress condition in the reactor. For example, a control unit may maintain a specific temperature or temperature range, a specific pH or pH range, or specific salt or chemical concentration or concentration range in the bioreactor. In some embodiments, the environmental control unit comprises a temperature control unit capable of maintaining a constant temperature of at least 60° C. in the bioreactor. In other embodiments, a chemical control unit comprises a pH control unit capable of maintaining a pH at least 9 or a pH of 5 or below in the bioreactor. In certain embodiments, the temperature control unit is capable of maintaining a temperature of at least 40° C., at least 45° C., at least 50° C., at least 55° C., at least 60° C., at least 65° C., at least 70° C., at least 75° C., at least 80° C., at least 85° C., at least 90° C., or at least 95° C. In a chemical control unit is capable of maintaining a pH of at least 8, at least 8.5, at least 9, at least 9.2, at least 9.4, at least 9.6, at least 9.8, or at least 10, or a pH up to 6, up to 5.5, up to 5, up to 4.8, up to 4.6, up to 4.4, up to 4.2, or up to 4.

In certain embodiments, systems may further comprise a connector for conveying $H_2$ from a $H_2$ gas source into the bioreactor. In certain embodiments, systems may further comprise a connector for conveying air from an air source into the bioreactor. In certain embodiments, systems may further comprise a connector for conveying $O_2$ from an $O_2$ gas source into the bioreactor.

In certain embodiments, systems may further comprise a collection unit for collecting the alcohol or epoxide product. In further embodiments, the collection unit further comprises a condenser. A condenser may be used to cool the gas vapors that outflow from the bioreactor into the collection unit into liquid. Collection units may further comprise a distillation unit for separating the alcohol or epoxide product from water byproduct or other impurities.

In certain embodiments, systems may further comprise a recycling unit for recycling any unconverted light alkane or alkene in the gas substrate back into the bioreactor for biocatalysis.

In certain embodiments, a gaseous substrate comprises methane, and a corresponding alcohol product comprises methanol. In certain embodiments, a gaseous substrate comprises ethane and a corresponding alcohol product comprises ethanol. In certain embodiments, a gaseous substrate comprises propane and a corresponding alcohol product comprises propanol. In further embodiments, propanol substantially comprises n-propanol. In certain embodiments, a gaseous substrate comprises butane and a corresponding alcohol product comprises butanol. In further embodiments, butanol substantially comprises n-butanol. In certain embodiments, a gaseous substrate comprises a mixture of light alkanes (any combination of two or more of the following alkanes: methane, ethane, propane, and butane). In certain embodiments, a gaseous substrate comprises ethylene and a corresponding epoxide product comprises ethylene oxide. In certain embodiments, a gaseous substrate comprises propylene and a corresponding epoxide product comprises propylene oxide. In certain embodiments, a gaseous substrate comprises butene and a corresponding epoxide product comprises butene oxide. In certain embodiments, a gaseous substrate comprises butadiene and a corresponding epoxide product comprises butadiene 1,2 oxide.

In certain embodiments, the gas phase bioreactor is a fluidized bed reactor. In certain embodiments, a solid matrix is a polypropylene ring, ceramic bio-ring, ceramic saddle, fibrous support (e.g., membrane), porous glass bead, polymer bead, charcoal, activated carbon, dried silica gel, particulate alumina, Ottawa sand, clay, polyurethane cell support sheet, or fluidized bed particle carrier (e.g., sand, granular-activated carbon, diatomaceous earth, calcium alginate gel bead). In certain embodiments, the solid matrix comprises polypropylene, ceramic, glass charcoal, sand activated carbon, or diatomaceous earth. In certain embodiments, the non-naturally occurring microorganism or cell-free fraction derived thereof is immobilized on a solid matrix in a substantially non-aqueous state (e.g., lyophilized).

EXAMPLES

Example 1

*Methylosinus trichosporium* Methanotroph Growth and Transformation

Media Preparation.
Preparation of NMS Media.

| | |
|---|---|
| $MgSO_4 \cdot 7H_2O$ | 1.0 g |
| $CaCl_2 \cdot 6H_2O$ | 0.20 g |
| Chelated Iron Solution (see below) | 2.0 ml |
| $KNO_3$ | 1.0 g |
| Trace Element Solution (see below) | 0.5 ml |
| $KH_2PO_4$ | 0.272 g |
| $Na_2HPO_4 \cdot 12H_2O$ | 0.717 g |
| Purified Agar (e.g., Oxoid L28) | 12.5 g |
| Distilled deionized water | 1.0 L |

Adjust pH to 6.8. Autoclave at 121° C. for 15 minutes.

Chelated Iron Solution:

| | |
|---|---|
| Ferric (III) ammonium citrate* | 0.1 g |
| EDTA, sodium salt | 0.2 g |
| HCl (concentrated) | 0.3 ml |
| Distilled deionized water | 100.0 ml |

*0.5 g of Ferric (III) chloride may be substituted.
Use 2.0 ml of this chelated iron solution per liter of final medium.

Trace Element Solution:

| | |
|---|---|
| EDTA | 500.0 mg |
| $FeSO_4 \cdot 7H_2O$ | 200.0 mg |
| $ZnSO_4 \cdot 7H_2O$ | 10.0 mg |
| $MnCl_2 \cdot 4H_2O$ | 3.0 mg |
| $H_3BO_3$ | 30.0 mg |
| $CoCl_2 \cdot 6H_2O$ | 20.0 mg |
| $CaCl_2 \cdot 2H_2O$ | 1.0 mg |
| $NiCl_2 \cdot 6H_2O$ | 2.0 mg |
| $Na_2MoO_4 \cdot 2H_2O$ | 3.0 mg |
| Distilled water | 1.0 L |

Autoclave at 121° C. for 15 minutes.

Growth and Conjugations. The procedure for conjugating plasmids from *E. coli* into methanotrophs was based on the method developed by Martin, H. & Murrell, J. C. (1995). Methane monooxygenase mutants of *Methylosinus trichosporium* constructed by marker exchange mutagenesis. FEMS Microbiol. Lett. 127:243-248.

Briefly, a mobilizing plasmid to be conjugated was first transformed into *E. coli* S17-1 using standard electroporation methods. Transformation was confirmed by selection of kanamycin-resistant colonies on LB-agar containing 20 ug/mL kanamycin. Transformed colonies were inoculated into LB media containing 20 ug/mL kanamycin and shaken overnight at 37° C. A 10 mL aliquot of the overnight culture was then collected on a sterile 47 mm nitrocellulose filter (0.2 mm pore size). The *E. coli* donor strain was washed on the filter with 50 mL sterile NMS media to remove residual media and antibiotic.

In parallel, a sample of the *M. trichosporium* OB3b recipient strain was inoculated into 100 mL serum bottles containing 20-50 mL NMS media. The headspace of the bottles was then flushed with a 1:1 mixture of oxygen and methane, and the bottles were sealed with butyl butyl rubber septa and crimped. The bottles were shaken continuously in a 30° C. incubator until reaching an OD600 of approximately 0.3. The cells were then collected on the same filter as the *E. coli* donor strain. The filter was again washed with 50 mL of sterile NMS media. The filter was placed (cells up) on an NMS agar plate containing 0.02% (w/v) proteose peptone and incubated for 24 h at 30° C. in the presence of methane and oxygen. After 24 h, cells were resuspended in 10 mL sterile (NMS) medium before being concentrated by centrifugation. The pellet was resuspended in 1 mL sterile NMS media. Aliquots (100 ul) were spread onto NMS agar plates containing 10 ug/mL kanamycin.

The plates were incubated in sealed chambers containing a 1:1 mixture of methane and oxygen maintained at 30° C. The gas mixture was replenished every 2 days until colonies formed, typically after 7-14 days. Colonies were streaked onto NMS plates containing kanamycin to confirm kanamycin resistance as well as to further isolate transformed methanotroph cells from residual *E. coli* donor cells.

Example 2

Introduction of a Thermostable pMMO Gene into *Methylosinus trichosporium* Methanotroph Codon optimized versions of all pMMO subunits from *Methylothermus thermalis* (SEQ ID NOs:176 and 648) are synthesized with appropriate promoters. The genes are then cloned and transformed into both the wild-type *M. trichosporium* as described above. Transformation is confirmed by resistance of the cells to antibiotic selection, and gene expression is confirmed by northern blot (to confirm RNA transcription), western blot, or ELISA methods (to confirm protein expression).

To confirm activity of the thermostable pMMO enzyme, the transformed cells and non-transformed controls are inoculated into 100 mL serum bottles containing 20-50 mL NMS media and 10 ug/mL kanamycin. The bottle headspace is flushed with a 1:1 mixture of methane and oxygen, and the bottles are sealed with butyl rubber septa and crimped. The bottles are then shaken continuously while being incubated at 30° C. The headspace gas is refreshed every 2 days until an OD600 of ~0.5 is reached. Cells are collected by centrifugation, washed with 25 mM MOPS [3-(N-morpholino) propane sulfonic acid], 2 mM L-cysteine, and 1 mM $CuSO_4$, pH 7.0, then resuspended in an equal volume of the same buffer. Cell preparations are assayed for MMO activity, which is defined herein as the quantity of propylene oxide formed per milligram of dry cell weight per minute. The reaction vessels consist of vials with 10 ml headspace sealed with aluminum caps and polytetrafluoroethylene-lined butyl rubber septa. 1 mL of cell suspension is aliquoted to each vial and the vials are sealed and crimped. The reaction mixtures are warmed to 28° C. or 60° C., and incubated for 10 minutes prior to the addition of substrate. Following injection of propylene and $O_2$ into the headspace (1:1 mixture), the vials are shaken at 150 rpm or 200 rpm on a rotary shaker at the appropriate temperature. Samples from the aqueous phase are removed after 30 minutes and analyzed by gas chromatography. To achieve multiple enzyme turnovers, $H_2$ is included in the gas mixture at equal volumetric ratio. Thermophilic pMMO activity is determining by comparing the difference in observed propylene oxidation activity at 60° C. between the transformed and untransformed cells.

Gas chromatography. Propylene oxide formation is quantified with a Shimadzu model GC-14A gas chromatograph containing a glass column (2.6 mm inner diameter, 3.1 m) packed with 80×100 mesh Carbopack C+0.1% SP-1000 (Supelco). The gas chromatograph is configured with an AOC-17 auto-injector and a Shimadzu CR-601 Chromatopac recorder. Helium is used as a carrier gas (20 ml/min). The injector and detector (flame-ionization detector) temperatures are respectively 200° C. and 175° C. Aqueous samples are run isothermally at 80° C. for 6 minutes. Product formation is quantified in the single-time-point assay by comparison of peak area to a standard regression curve.

Example 3

Alcohol Production by a Thermostable pMMO in *Methylosinus trichosporium* Methanotroph Bottle grown cultures of the thermostable pMMO-transformed strains described above are inoculated 1:100 into 1 L NMS media in a 3 L New Brunswick jacketed fermentation vessel. The cultures are stirred at 800 rpm with a constant feed of 50 mL/min methane and 100 mL/min $O_2$. pH is maintained by on-line addition of NaOH and HCl as appropriate. Temperature is maintained at 30° C. Additions of $NaNO_3$, $KHPO_4$, $CuSO_4$, and Fe-EDTA are performed at intervals according to the growth rate of the cells. Cells are harvested in late log phase (OD~25) by centrifugation and washed with MOPS buffer as above.

Cells are immobilized on a solid-phase support, for example ISOLITE™, which is a diatomaceous earth product (78% $SiO_2$, 12% $Al_2O_3$ and 5% $Fe_2O_3$), which is used to immobilize cells and for soil aeration. This is an inert material with no adsorption capacity for many organic molecules. The ISOLITE™ is prewashed in deionized water to eliminate dust, then dried in an oven at 120° C. for 48 hours. Three hundred ml samples of resuspended cells are added to 150 grams of ISOLITE™ in a flask. The flask is then placed on an incubator/shaker (20 rpm at 55° C.) for one hour to allow the cells to bind to the ISOLITE™. The aqueous phase is then removed from the ISOLITE™ and the solid phase is dried and packed into a standard 1 cm diameter stainless steel reactor. The reactor is heated to 60° C. and connected to a continuous feed of 10 mL/min 25:25:50 methane:$H_2$:$O_2$. The reactor outlet is split at 1:100 for continuous offgas analysis by gas chromatography while the majority of the flow passes to a condenser to capture both water and methanol. Methanol is detected in real-time by gas chromatography as well as by assessing the bulk material captured in the condenser at various time points.

Example 4

*Methylococcus capsulatus* Methanotroph Growth and Transformation

Growth and Conjugations. The procedure for conjugating plasmids from *E. coli* into methanotrophs was based on the method developed by Martin, H. & Murrell, J. C. (1995). Methane monooxygenase mutants of *Methylococcus capsulatus* constructed by marker exchange mutagenesis. FEMS Microbiol. Lett. 127:243-248.

Briefly, a mobilizing plasmid to be conjugated was first transformed into *E. coli* S17-1 using standard electroporation methods. Transformation was confirmed by selection of kanamycin-resistant colonies on LB-agar containing 20 ug/mL kanamycin. Transformed colonies were inoculated into LB media containing 20 ug/mL kanamycin and shaken overnight at 37° C. A 10 mL aliquot of the overnight culture was then collected on a sterile 47 mm nitrocellulose filter (0.2 mm pore size). The *E. coli* donor strain was washed on the filter with 50 mL sterile NMS media to remove residual media and antibiotic.

In parallel, a sample of the *M. capsulatus* recipient strain was inoculated into 100 mL serum bottles containing 20-50 mL NMS media. The headspace of the bottles was then flushed with a 1:1 mixture of oxygen and methane, and the bottles were sealed with butyl butyl rubber septa and crimped. The bottles were shaken continuously in a 45° C. incubator until reaching an OD600 of approximately 0.3. The cells were then collected on the same filter as the *E. coli* donor strain. The filter was again washed with 50 mL of sterile NMS media. The filter was placed (cells up) on an NMS agar plate containing 0.02% (w/v) proteose peptone and incubated for 24 h at 37° C. in the presence of methane and oxygen. After 24 h, cells were resuspended in 10 mL sterile (NMS) medium before being concentrated by centrifugation. The pellet was resuspended in 1 mL sterile NMS media. Aliquots (100 μl) were spread onto NMS agar plates containing 10 μg/mL kanamycin.

The plates were incubated in sealed chambers containing a 1:1 mixture of methane and oxygen maintained at 45° C. The gas mixture was replenished every 2 days until colonies formed, typically after 7-14 days. Colonies were streaked onto NMS plates containing kanamycin to confirm kanamycin resistance as well as to further isolate transformed methanotroph cells from residual *E. coli* donor cells.

Example 5

Deletion of adh Genes from *Methylococcus Capsulatus* Methanotroph

Native adh genes that may reduce production yield by oxidizing methanol are removed from *M. capsulatus*. Synthetic cDNA constructs of the *M. capsulatus* adh genes Genbank Accession #AAU92947.1 (SEQ ID NO:655), #AAU92153.1 (SEQ ID NO:656), and #AAU91107.1 (SEQ ID NO:657) are synthesized, incorporating several stop mutations and frame shifts in the 5' region of each gene. These cDNA constructs are cloned into an appropriate vector for conjugation, but lacking an origin of replication that functions in methanotrophs, and introduced into *M. capsulatus* using the methods described above. This technique ensures that any kanamycin resistant *M. capsulatus* colonies must have been incorporated into the genome by recombination.

Identification of homologous recombination events is well-established in the art, and typically performed by PCR and sequencing using unique primers in the genome and the vector construct to confirm proper insertion. Homologous recombinants are then grown in the absence of selective pressure (e.g. kanamycin) for several generations, and sensitive clones which have lost the resistance marker are identified by replica plating (or equivalent technique). Approximately 50% of sensitive revertants possess the mutated form of the target gene in place of the wild-type version. Loss of the target adh genes is confirmed by whole genome sequencing.

Example 6

Introduction of a Thermostable pMMO Gene into *Methylococcus capsulatus* Methanotroph Codon optimized versions of all pMMO subunits from *Methylothermus thermalis* (SEQ ID NOs:176 and 648) are synthesized with appropriate promoters. The genes are then cloned and transformed into both the wild-type *M. capsulatus* and the adh knockout strains as described above. Transformation is confirmed by resistance of the cells to antibiotic selection, and gene expression is confirmed by northern blot (to confirm RNA transcription), western blot, or ELISA methods (to confirm protein expression).

To confirm activity of the thermostable pMMO enzyme, the transformed cells and non-transformed controls are inoculated into 100 mL serum bottles containing 20-50 mL NMS media and 10 ug/mL kanamycin. The bottle headspace is flushed with a 1:1 mixture of methane and oxygen, and the bottles are sealed with butyl rubber septa and crimped. The bottles are then shaken continuously while being incubated at 45° C. The headspace gas is refreshed every 2 days until an OD600 of ~0.5 is reached. Cells are collected by centrifugation, washed with 25 mM MOPS [3-(N-morpholino) propane sulfonic acid], 2 mM L-cysteine, and 1 mM $CuSO_4$, pH 7.0, then resuspended in an equal volume of the same buffer. Cell preparations are assayed for MMO activity, which is defined herein as the quantity of propylene oxide formed per milligram of dry cell weight per minute. The reaction vessels consist of vials with 10 ml headspace sealed with aluminum caps and polytetrafluoroethylene-lined butyl rubber septa. 1 mL of cell suspension is aliquoted to each vial and the vials are sealed and crimped. The reaction mixtures are warmed to 40° C. or 80° C., and incubated for 10 minutes prior to the addition of substrate. Following injection of propylene and $O_2$ into the headspace (1:1 mixture), the vials are shaken at 150 rpm or 200 rpm on a rotary shaker at the appropriate temperature. Samples from the aqueous phase are removed after 30 minutes and analyzed by gas chromatography. To achieve multiple enzyme turnovers, $H_2$ is included in the gas mixture at equal volumetric ratio. Thermophilic pMMO activity is determining by comparing the difference in observed propylene oxidation activity at 80° C. between the transformed and untransformed cells.

Gas chromatography. Propylene oxide formation is quantified with a Shimadzu model GC-14A gas chromatograph containing a glass column (2.6 mm inner diameter, 3.1 m) packed with 80×100 mesh Carbopack C+0.1% SP-1000 (Supelco). The gas chromatograph is configured with an AOC-17 auto-injector and a Shimadzu CR-601 Chromatopac recorder. Helium is used as a carrier gas (20 ml/min). The injector and detector (flame-ionization detector) temperatures are respectively 200° C. and 175° C. Aqueous samples are run isothermally at 80° C. for 6 minutes. Product formation is quantified in the single-time-point assay by comparison of peak area to a standard regression curve.

Example 7

Alcohol Production by a Thermostable pMMO in *Methylococcus capsulatus* Methanotroph Bottle grown cultures of the thermostable pMMO-transformed *M. capsulatus* strains described above are inoculated 1:100 into 1 L NMS media in a 3 L New Brunswick jacketed fermentation vessel. The cultures are stirred at 800 rpm with a constant feed of 50 mL/min methane and 100 mL/min $O_2$. pH is maintained by on-line addition of NaOH and HCl as appropriate. Temperature is maintained at 45° C. Additions of $NaNO_3$, $KHPO_4$, $CuSO_4$, and Fe-EDTA are performed at intervals according to the growth rate of the cells. Cells are harvested in late log phase (OD~15) by centrifugation and washed with MOPS buffer as above.

Cells are immobilized on a solid-phase support, for example ISOLITE™, which is a diatomaceous earth product (78% $SiO_2$, 12% $Al_2O_3$ and 5% $Fe_2O_3$) that is used to immobilize cells and for soil aeration. This is an inert material with no adsorption capacity for many organic molecules. The ISOLITE™ is prewashed in deionized water to eliminate dust, then dried in an oven at 120° C. for 48 hours. Three hundred ml samples of resuspended cells are added to 150 grams of ISOLITE™ in a flask. The flask is then placed on an incubator/shaker (20 rpm at 75° C.) for one hour to allow the cells to bind to the ISOLITE™. The aqueous phase is then removed from the ISOLITE™ and the solid phase is dried and packed into a standard 1 cm diameter stainless steel reactor. The reactor is heated to 80° C. and connected to a feed of 10 mL/min 10:10:10:10:50 methane:ethane:propane:butane:$O_2$. This feed is alternated with a feed of 10 mL/min $H_2$ gas to regenerate the pMMO catalyst. The reactor outlet is split at 1:100 for continuous offgas analysis by gas chromatography while the majority of the flow passes to a condenser to capture both water and product alcohols. Mixed alcohol production is detected in real-time by gas chromatography as well as by assessing the bulk material captured in the condenser at various time points.

The disclosure of U.S. provisional patent application Ser. No. 61/714,123, filed Oct. 15, 2012, is incorporated herein in its entirety.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (665 sequences)

SEQ ID NO: 1 - protein, 177 aa, Bathymodiolus symbiont
  uncultured gamma proteobacterium
GDWDFWTDWKDRRLWVTVAPIVSITFPAAVQSMLWYRYRLPFGAVVCVMALMIGEWINRYLNFWGWTYFPVNFCFPSNLVPGAIILDVVLMMSSSFVLTAVIGGMAWGLVFYPGNWPIIAPLHVPVEYNGMMFTLADLQGYHYVRTGTPEYIRMVEKGTLRTFGKDVAPVSAFFSAF

SEQ ID NO: 2 - protein, 107 aa, Clonothrix fusca
NFWGWTYFPVNFCFPSQLLPGAILLDVILLLSNSMTLTAVVGGLAFGLIFYPGNWPVIAPLHVPVEYNGMVMTLADLQGYHYVRTGTPEYIRMVEKGTLRTFGNDVA

SEQ ID NO: 3 - protein, 177 aa, Crenothrix polyspora
GDWDFWLDWKDRQWWPIVTPVTLITFCAAVQYYNWVNYRQPFGATLCILALGAGKWMAVYTSWWWWSNCPPNFVMPATAIPGALVLDITLLLTRNWTLTAVIGAWMFAALFYPSNWPIFAYSHTPLVVDGALLSWADYMGFMYVRTGTPEYIRMIEVGSLRTFGGHSTMISAFFSAF

SEQ ID NO: 4 - protein, 177 aa, Crenothrix polyspora
GDWDFWLDWKDRQWWPIVTPVTLITFCAAVQYYNWVNYRQQFGATLCILALGAGKWMAVYTSWWWWSNYPPNFVMPATAIPGALVLNITLLLTRNWTLTAVIGAWMFAALFYPSNWPIFAYSHTPLVVDGALLSWADYMGFMYVRTGTPEYIRMIEVGSLRTFGGHSTMISAFFSAF

SEQ ID NO: 5 - protein, 177 aa, Crenothrix polyspora
GHWDFWLDWKDRQWWPIVTPVTLITFCAAVQYYNWVNYRQPFGATLCILALGAGKWMAVYTSWWWWSNYPPNFVMPATAIPGALVLDITLLLTRNWTLTAVIGAWMFAALFYPSNWPIFAYSHTPLVVDGALLSWADYMGFMYVRTGTPEYIRMIEVGSLRTFGGHSTMISAFFSAF

SEQ ID NO: 6 - protein, 177 aa, Crenothrix polyspora
GTGDFWLDRKDRQWWPIVTPVTLITFCAAIQYYNWVNYRQPFGATLCILALAVGKWIAVYTSWWWWSNYPPNFVMPATAIPGALVLDITLLLTRNWTLTAVIGAWMFAALFYPSNWPIFADSHTPLVVDGALLSWADYMGFMYVRTGTPEYIRMIEVGSLRTFGGHSTMISAFFSAF

SEQ ID NO: 7 - protein, 177 aa, Crenothrix polyspora
GDWDFWLDWKDRRWWPIVTPVTLITFCAAIQYYNWVNYRQPFGATLCILALAVGKWIAVYTSWWWWSNYPPNFVMPATAIPGALVLDITLLLTRNWTLTAVIGAWMFAALFYPSNWPIFADSHTPLVVDGALLSWADYMGFMYVRTGTPEYIRMIEVGSLRTFGGHSTMISAFFSAF

SEQ ID NO: 8 - protein, 177 aa, Crenothrix polyspora
GDWDFWLDWKDRQWWPIVTPVTLITFCAAIQYYNWVNYRQPFGATLCILALALGKWIAVYTSWWWWSNYPPNFVMPATAIPGALVLDITLLLTRNWTLTAVIGAWMFAALFYPSNWPIFAYSHTPLVVDGALLSWADYMGFMYVRTGTPEYIRMIEVGSLRTFGGHSTMISAFFSAF

SEQ ID NO: 9 - protein, 160 aa, Artificial Sequence
  endosymbiont of Bathymodiolus azoricus
WKDRRLWVTVAPIVSITFPAAVQACLWYRYRLPFGAIVCVLALMLGEWINRYLNFWGWTYFPVNFCFPSNLIPGAILLDVVLMLSSSFVLTAVVGGMAWGLVFYPGNWPIIAPLHVPVEYNGMMFTLADLQGYHYVRTGTPEYIRMVEKGTLRTFGKDVA

SEQ ID NO: 10 - protein, 370 aa, Haliea  ETY-M
MKIRGEEILIPTSMVGNYPNPRWWDASWGRHFRGDQEPPDSMNREALEDVIAAVALDQEKAGLDIISDGRVHADNYADAAVYYYLNRLGYNLQGGHLGFPIYSRLHSGTVEKEIKRYGALMVEQAKALLRATDKPVKIQYTGVQVLAQCSNDLFYEDPRDRAMAIAGAMNEDIRELDKLGVDFIQLDEFTWPYFYEDWAIDAFNAAVEGVENARIIVHVCWGNWGGTPAYYPDDTAEAGEVFDLTKRSENAEAPSATRSVVPASYDANIDVLNLENCGRRSDDHSGLDTFKEFPLPENVDFWAGVIDVKSTICETAEEVAGRIRTLLEVIPADRLGVTTDCGLILLQRYIAQDKLHAMVEGTKIVRGELS

SEQ ID NO: 11 - protein, 279 aa, Haliea  ETY-M
MTTSRTDAAVAASTENDDTGSRAWKAWLKPAIIGCALMSMMYIGVLMYQDVMGWKYGLDSTSAEFDTYWMTLFWAQIIILPLVAVGTWAFLWFTRDRDLANLDPQEEVVRYLRLLGIILVYCFAIYWAASYFAEQDGSWHQTVVRDTSFTPSHIAIFYLSFPVYIIAGVSAFLYAMTRLPKFANGISIPFALAVTGPFMILPNVGLNEWGHAFWIMEEWFTAPLHWGFVVFGWSALALFGLASQIGLGIIDALKRAYGDAEDFRIPGPTDDMLEYSHQA

SEQ ID NO: 12 - protein, 284 aa, Haliea  ETY-M
MFNSNKVDPVLQAAGLRTPAAISSSRAFDIVIATLAIFLMAGSFHIHFMLLAGDWDFWVDWKDRQFWVSITPVVAMVFPAAAQAWLWRMFRVPFGATFVVLCLILAEWISRIFAFNGWVHFPYSLVWPATMIPGAIVLDMVLLLTRSWLMTGIFGAWAFGLMFYPGNWPMLAAYRLPMEHMGQLATSGDLIGYHFVRSATPEYLRYIERGTLRTFGGESAIIASFFAAFMCSLVYFVFWHVGVLASKIHYLPNQFKKFMGMGGMKDTDTFGGHQHVGEPKGAQS

SEQ ID NO: 13 - protein, 392 aa, Haliea  ETY-M
MRTLQWYDVTWTKEDGTPADEIGVNDRVIVEGKFRAIEDWPANVPELDMAFLSTAGPSSVFVKIESYIDDVPMIQSTQLEFKREYRFKLIMAGRIPGNYHLHPTVMVQGGGPIIGPGKWVNITGSAADFKLPATTLSGEEIPNLETWGVSTVVTWHLLWIAIAAFWLLWWLRRPLLMPRFIANKKGGNEDILITPLDQKVAFGMLVGTIVIVVAGNQWANSKYPRTTPLQGAVMRLPNKAPVEELVSAIVREADYDVPGRTMRFNVELTNNAERPVQVGEFSTASIRFLDADIEAASSGIHASFPDELINYGLTTSDNSPLMPGETRTVSVKASDAAWETERLADLVKDPVNRFAGLLMFYDDGGERHITEINGAVVPVFVLDSAERVATAD

SEQ ID NO: 14 - protein, 211 aa, Haliea ETY-M
MSLRLNTVFRICLFVLLGGMSALSAAHGGRPMEEDNCAAWIRGDKPGKAHKVHIALYQPGAETARDVGDGAYEEMCREVRYPGETVIVFDIVSHELRERTFNIEIGPAPDQDESDLAGGAGDSFLADNYTFFSVPNGTMQVTKQLTAGMYQIELAVEDFSTPAVFDFVVGSEAGDGPSLDLSPNALFMAILGVLIVLAILAGRGRGTGDAA

SEQ ID NO: 15 - protein, 244 aa, Haliea  ETY-M
MELDQCKLSIGPYYMHFSGYQKGDRKNTEFCEDMPLVAPTIVVFDFTDNVMRDMEVEILVVPNVDITGDPSRDGALVFEKPPTRYRNGSIKIGLDFSERGYFVGIVRAIADSGQAWESRFPFSVGYTSWYTGNIKVDRHRNRSAAGRARIVPPRPLARRAHWMSDRREESLHTARPPHSNPGNSSRLFVVFCGALGIQRGLLASRLPWTRNRLSRSNPARPTSMWHGAPPRPSTAFRWKRTRLA

SEQ ID NO: 16 - protein, 383 aa, Haliea  ETY-NAG
MKIRGEDVVIPTSMVGNYPNPRWWDASWGRHFRGDQEPPDSMNREALEDVMAAVALDQEQAGLDIISDGRVHGDNYADAAVYYYLKRLGLNLQGGHLGFPIYSRLHSGTVEKEIRRYGALMVEQAKARLRATDKPVKIQYTGVQVLAQCSNDLFYDNPRDRAMAIAQAMNEDIRELDKLGVDFIQLDEFTWPYFYEDWAIDAFNAAVEGVENARVIVHVCWGDWGGTPAYYPDDTAEQGEVFDLTKRKQDAKAPSATRSVVPASYDANINVLNLENCGRRSDDHSGLEVFKEFPLPENVDFWAGVIDVKSTICETAEEVAGRIRALAEVIPADRLGVTTDCGLILLQRYIAQDKLHALVEGTKIVREELSRQTNVREPVSRQA

SEQ ID NO: 17 - protein, 279 aa, Haliea  ETY-NAG
MTTSSNDVRAPASDLSDDTGDRAWKAWLKPSIIGVALISVMYIAVLQYQDIMGWKYGLDSTSAEFDKYWMTLFWSQIIILPVAAVAIWAFLWFTRDRDLSNLDPKEEVVRYLRLLGLILLYTFCIYWAASYFAEQDGSWHQTVVRDTSITPSHIAIFYLSFPVYIIAGVSAFLYAMTRLPKFANGISIPFALAVTGPFMILPNVGLNEWGHAFWIMEEWFTAPLHWGFVVFGWSALALFGLASQIGLGIIDALKRAYGDAEDFRIPGPTDDMLEYSHEM

SEQ ID NO: 18 - protein, 285 aa, Haliea  ETY-NAG
MFSLINRSDPVLEAAGLRTPAAISSSRAFDIVIATLAIFLMAGSFHIHFMLLAGDWDFWVDWKDRQFWVSITPIVAIVFPAAAQAWLWRMFRVPFGATFVVLCLILAEWVSRIFAFHGWVYFPYSLVWPATLLPGAIVLDMVLLLTRSWLFTGIFGAWAFGLMFYPSNWPMLAAYRVPAEHMGQMATVGDLIGYHFIRSATPEYLRYIERGTLRTFGGESALIASFFAAFMCSMVYFLFWHVGVLASKIHYLPNQMKKFMGMGGMKETDTFTGHQVPSELEGARS

SEQ ID NO: 19 - protein, 392 aa, Haliea  ETY-NAG
MRTLQWYDVTWTKTDGSPATEIAVNEDVIVQGKFRAIEDWPKNVPPLDMAFLSTAGPSSVFVKMESYIDEVPMIQSTQLEFRREYEFKLVMRGRIPGNFHLHPTVMVQGGGPIIGPGAWVNITGAWEDFSLPLTTLTGEEIDNLETWGVSTVVTWHLLWIAVAAFWLLWWLRRPLLTPRFIANKKGGNEDILITRSDQLAGVILLVGTIAAVVVGNQWANSKFPQTSPLQGSVMKLPSAPPVEELVTAFIREADYDVPGRTMRFDVELTNNAERPVQIGEFGTASIRFLNPDVAAATQNIHESFPRVLVNYGLSVNNNEPLQPGETRIISVKASDAAWETERLADLVKDPVNRFAGLLMFYDDLGTRHITEVSGAVVSVFVPISEDRLAAAD

SEQ ID NO: 20 - protein, 213 aa, Haliea  ETY-NAG
MPASDSRILQIISILLFLAAPMASYGHGGQTMEEDTCVSWIRGEAPGEIYKVHVTLYQTNTSESASLSPGGYEELCREIPEPGEVYVVFDIINHELRERTFSLDIYPVASEETANEDAAFDEEWPESKYTFISAPDGTMYVTKYFGAGSYKIDLAVEDLESIGTFDFTVGSKQANSLIPVLSPGTRYMLVVGVLILVATVFGHRRYLQLRSPR

SEQ ID NO: 21 - protein, 169 aa, Haliea  ETY-NAG
MMNPLKVMAHGGLAMEFDQCKLTIGPYYMHFSGYQKGDSKNTEFCEDMPFVAQTFIVFDFIDNVMRAMEIEVQVVRNVDLVGDPASDGELIYAKPPTSYRSGSIKVGLDFDDPGYYVGIVKATSPTGESFESRFPFSVGFQSWYDGKLGWLLILLLSFLIGVIFYMRIR

SEQ ID NO: 22 - protein, 157 aa, Unknown
  methanotroph isolate 1
TDWKDRRLWVTVAPIVSITFPAAVQATLWYRFRLPFGAVVAVLGLLLGEWVNRYLNLWGWTYFPVNFCFPSNLMPGAIVLDVVLMLSGSMTLTAVVGGMAWGLLFYPGNWPIIAPLHIPVEYNGMMFTLADLQGYHYVRTGTPEYIRMVEKGTLRTF

SEQ ID NO: 23 - protein, 157 aa, Unknown
  methanotroph isolate 2
TDWKDRRLWVTVAPIVSITFSAAVQATLWYRFRLPFGAVVAVLGLLLGEWVNRYLNFWGWTYFPVNFCFPSNLMPGAIVLDVVLMLSGSMTLTAVVGGMAWGLLFYPGNWPIIAPLHIPVEYNGMMFTLADLQGYHYVRTGTPEYIRMAEKGTLRTF

SEQ ID NO: 24 - protein, 165 aa, Unknown
  methanotroph FL-DIKO
VDWKDRRLWVTVTPIVLVTFPAAVQSYLWERFRLPWGATVCVLGLLLGEWINRYFNFWGWTYFPINFVFPASLVPGAIILDTVLMLSGSYLFTAIVGAMGWGLIFYPGNWPIIAPLHVPLEYNGMLMSIADIQGYNYVRTVTPEYIRMVERGTVRTFGKDVVPVA

SEQ ID NO: 25 - protein, 196 aa, Methylobacter marinus
VDWKDRQWWPLVTPLIGITFPAAVQAVLWDKFRLPLGATLCVTALLLGTWVTRVFAYHYWNYFPINMVLPATMLPGALVLDALLMLTNSLTITSIFGGAAFALLFYPSNWPIFGMFHQPVEYANSQLTVADLFGFQYIRTGMPEYLRIIERGTLRTYGQYATPLSAFCSALLCSLMYPLWWHIGKWFASTRYLTKI

SEQ ID NO: 26 - protein, 95 aa, Methylobacter marinus
MKTHFKTWLLALIGLTVLSGLPMSSAQAHGEKALEPFIRMRTIQWYDVQWSTQKFNVDDEVSVSGKFHVAEDWPISVPKPEASFLNISTPGPVLI

SEQ ID NO: 27 - protein, 160 aa, Methylobacter psychrophilus
WKDRRLWVTVAPIVSITFPAAVQACLWYRYRLPFGAVVCVLGLLLGEWVNRYLNFWGWTYFPVNFCFPSNLMPGAIVLDAILMLTGSVTVTAVVGGLAWGLLFYPGNWPIIAPLHVPVEYNGMMMTLADLQGYHYVRTGTFEYIRMVEKGTLRTFGKDVA

SEQ ID NO: 28 - protein, 159 aa, Methylobacter  5FB
DWKDSRLWVTVAPIVSITFPAAVQATLWYRFRLPFGAVVSVLGLLLGEWVNRYMNFWGWTYFPVNFVFPSNLMPGAIVLDVILMLSNSMTLTAVVGGLAWGLLFYPGNWPIIAPLHIPVEYNGMMFTLADLQGYHYVRTGTPEYIRMVEKGTLRTFGND

SEQ ID NO: 29 - protein, 169 aa, Methylobacter  BB5.1
GDWDFWTDWKDRRLWVTVAPIVSITFPAAVQACLWYRYRLPFGAVVCVLGLLLGEWVNRYLNFWGWTYFPVNFCFPSNLMPGAIVLDVVLMLSNSMTLTAVVGGMAWGLLFYPGNWPIIAPLHIPVEYNGMMFTLADLQGYHYVRTGTPEYIRMVEKGTLRTFGKDVAP

SEQ ID NO: 30 - protein, 141 aa, Methylobacter FIN1
YYGGVTDLPFGAVLCILGLLLGEWVNRYMNFWGWTYFPVNFCFPSNLMPGAIVIDVILMLTNSMTVTAVLGGMAWGLLFYPGNWPVIAPLHVPVEYNGMMMTLADLQGYHYVRTGTPEYIRMVEKGTLRTFGKDVAPVSAF

SEQ ID NO: 31 - protein, 116 aa, Methylobacter FIN2
VNRYMNFWGWTYFPVNFCFPSNLMPGAIVIDVILMLTNSMTVTAVLGGMAWGLLFYPGNWPVIAPLHVPVEYNGMMMTLADLQGYHYVRTGTPEYIRMVEKGTLRTFGKDVAPVSA

SEQ ID NO: 32 - protein, 141 aa, Methylobacter  FIN3; identical to SEQ ID NO: 30

SEQ ID NO: 33 - protein, 138 aa, Methylobacter  FIN4
WWRYRLPFGAVLCILGLLLGEWVNRYMNFWGWTYFPVNFCFPSNLMPGAIVIDVILMLTNSMTVTAVLGGMAWGLLFYPGNWPVIAPLHVPVEYNGMMMTLADLQGYHYVRTGTPEYIRMVEKGTLRTFGKDVAPVSA

SEQ ID NO: 34 - protein, 141 aa, Methylobacter  FIN5
GGVTDLPFGAVLCILGLLLGEWVNRYMNFWGWTYFPVNFCFPSNLMPGAIVIDVILMLTNSMTVTAVLGGMAWGLLFYPGNWPVIAPLHVPVEYNGMMMTLADLQGYHYVRTGTPEYIRMVEKGTLRTFGKDVAPVSAFFS

SEQ ID NO: 35 - protein, 153 aa, Methylobacter PP39C
ITFPAAVQACLWWRYRLPVGATLSVVALMVGEWINRYMNFWGWTYFPVNICFPSNLLPGAIVLDVILMMGNSMTLTAVVGGLAYGLLFYPGNWPVIAPLHVPVEYNGMMMTLADLQGYHYVRTGTPEYIRMVEKGTLRTFGKDVAPVSAFFSA

SEQ ID NO: 36 - protein, 153 aa, Methylobacter PP39D
TFPAAVQAVLWWRYRLPFGAVVCVLGLLLGEWVNRYLNFWGWTYFPVNFCFPSNLMPGAIVLDVVLMLTNSMTVTAVLGGMAWGLLFYPGNWPVIAPLHVPVEYNGMMMTLADLQGYHYVRTGTPEYIRMVEKGTLRTFGKDVAPVSAFFSAF

SEQ ID NO: 37 - protein, 169 aa, Methylobacter LW1
GDWDFWTDWKDRRLWVTVLPIVGITFPAAVQAVVWYRWRLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 38 - protein, 151 aa, Methylobacter tundripaludum
WVTVAPIVSITFPAAVQAVLWWRYRLPFGAVVCILGLLLGEWINRYLNFWGWTYFPVNFCFPSNLMPGAIVLDVVLMLSGSMTVTAVIGGMAWGLLFYPGNWPVIAPLHVPVEYNGMMMTLADLQGYHYVRTGTPEYIRMVEKGTLRTFGK

SEQ ID NO: 39 - protein, 250 aa, Methylobacter tundripaludum SV96
MSVNISNRSFRPYTGEKARITRAYDYLILVLALFLFIGSFHLHFALTVGDWDFWVDWKDRQWWPLVTPLMGITFPAAVQSVMWTKFRLPMGATLCVAALLIGTWITRIFAYHYWNYFPINMVLPATMLPGALVLDAILMLSNSLTVTAVLGGASFALLFYPSNWPLFGMFHVPVEYGNGQLTVADLFGFEYIRTGMPEYLRIIERGTLRTYGQYAAPLAAFCSALLCILMYTLWWFIGKWFATVRYLNKI

SEQ ID NO: 40 - protein, 413 aa, Methylobacter tundripaludum SV96
MKQLLIKCMASLGFILSLYTLNIATVMAHGEKALEPFIRMRTIQWYDVQWDKQKFNVNEEVSVSGKFHVAEDWPVSVPKPEAAFLNISTPGPVLIRTERYLNGKPFMNSVALQPGGDYNFKIVLKGRLPGRYHIHPFFNLKDAGQVMGPGVWLEITGSPSDFSNKVKTINGEVIDMETYGLGNGIFWHLFWGLLATAWLLWWLRRPLFIPRYRMLQAGGLEDELVTPNDRLIAKAMLVGVPLLVLAVNAMTISEYPNAIPLQASLDQILPLSAQVNAGVVDVETLKAEYRIPERSMEFTVKVNNRSENPVQIGEFSTANVHFLNKDLQAAYQGDSTSMTAFEGLSLENPAPIQPGEQRTMTITARDGFWESEKLNGLIRDADSRIGGLLFLYDSVTAARYISSITAAVIPKFN

SEQ ID NO: 41 - protein, 257 aa, Methylobacter tundripaludum SV96
MATTSEQLPLVVENKNAEPWYIKDLPMYLKGFAMLTVIYIGLRLYQGAFAVASGLDSSEPAFEQYWMQLFYVELGILAVFVTGVWGYLWLSRDRNLDKLEPKEEISRYFTLTMWISIYTFAVYWAGSYFAEQDNSWHQVAIRDTPFTANHIIEFYFNFPLYVILGGCAWLYARTRLPLYAKGISLPLTLAVFGPFMILVSVGFNEWGHTFWFREEFFAAPIHWGFVIGVWFALGVGGILLQGVTRLIELLDELEDAP

SEQ ID NO: 42 - protein, 250 aa, Methylobacter tundripaludum SV96
MAATTESVRADAAEAPLLNKKNMILGSLLYVVFYGWVRWYEGVYGWSAGLDSFAPEFETYWMNFLYIEFVLEVATAGILWGYIWKSRDRKVMSITPREELRRHFTHWTWLVMYGFAIYYGASYFTEQDGTWHQTIVRDTDFTPSHIIEFYLSYPIYIITGGAAFLYAKTRLPTYQQGLHLQYMVAVVGPFMILPNVGLNEWGHTFWFMEELFVAPLHYGFVFFGWAALGVMGVVNTEVIAIAKLLKKDLA

SEQ ID NO: 43 - protein, 247 aa, Methylobacter tundripaludum SV96
MSASQSAVRSRAEAVKVSRTFDWLILFVLFFVVLGGYHIHYMLTGGDWDFWTDWKDRRLWVTVAPIVSITFPAAVQAVLWWRYRLPFGAVVCILGLLLGEWINRYLNFWGWTYFPVNFCFPSNLMPGAIVLDVVLMLSGSMTVTAVIGGMAWGLLFYPGNWPVIAPLHVPVEYNGMMMTLADLQGYHYVRTGTPEYIRMVEKGTLRTFGKDVAPVSAFFSAFVSILIYFLWHFFGKWFGGTSFTQSA

SEQ ID NO: 44 - protein, 414 aa, Methylobacter tundripaludum SV96
MKLIKDKVAKLSFVALLVTVTAAMFYAPTASAHGEKSQAAFMRMRTIHWFDLNWSKDTVPVNDTMTISGKFHVFAGWPETVDKPEISFLNIGIPGPVFIRQGSWIGGQLVPRSVSLELGETYEFKVLLKARRPGDWHVHTMMNVKGGGPIIGPGKWVTVTGTMGSFVNPVTTLLGDTINLETYNLSNTYFWHAFWYALGLAWLGYWARKPIFVPRHIAVEAGKADSLITATDKKVAMGFAIGTIAVVAFGMSSTNAAYPVTTPLQAGLLRGMKPIEMPAKTVNVKVEDATYRVPGRAMQMTLTITNNGDSSVRLGEFNTAGVRFLDPKVHVDETGYPDDLLAEEGLTVSDNSPIAPGTSRTVQVTASDAAWEVYRLADLIYDPDSRFAGLLFFFDEAGNRQMIMVDAPLIPSFI

SEQ ID NO: 45 - protein, 250 aa, Methylobacter tundripaludum SV96; identical to SEQ ID NO: 39

SEQ ID NO: 46 - protein, 413 aa, Methylobacter tundripaludum SV96; identical to SEQ ID NO: 40

SEQ ID NO: 47 - protein, 257 aa, Methylobacter tundripaludum SV96; identical to SEQ ID NO: 41

SEQ ID NO: 48 - protein, 250 aa, Methylobacter tundripaludum SV96; identical to SEQ ID NO: 42

SEQ ID NO: 49 - protein, 247 aa, Methylobacter tundripaludum SV96; identical to SEQ ID NO: 43

SEQ ID NO: 50 - protein, 414 aa, Methylobacter tundripaludum SV96; identical to SEQ ID NO: 44

SEQ ID NO: 51 - protein, 176 aa, Methylocaldum gracile
GDWDFWSDWKDRRLWVTVTPIVLVTFPAAIQAWAWEKFRNPWGATIAVLALLFGEWVNRYFNFWGWTYFPINFVFPAVLVPGAILLDTFLMLSGSYLFTAIVGGMAWGLVFYPGNWPMIAPLHVPVEYNGMLMSIADIQGYNYVRTGTPEYIRMVEKGTLRTFGKDVAPVSAFFSA

SEQ ID NO: 52 - protein, 165 aa, Methylocaldum  5FB
VDWKDRRLWVTVTPIVLVTFPAAIQAWAWERFRNPWGATIAVLALLFGEWVNRYFNFWGWTYFPINFVFPAVLVPGAILLDTFLMLSGSYLFTAIVGGMAWGLVFYPGNWPVIAPLHVPVEYNGMLMSIADIQGYNYVRTGTPEYIRMVEKGTLYTFGKDVAPVS

SEQ ID NO: 53 - protein, 157 aa, Methylocaldum  BFH1
LWADWKDRRLWVTVTPIVLVTFPAAAQVFLWERFRQPWGATIAVLALLLGEWVNRYFNFWGWTYFPVNFVFPAILVPGAILLDTFLMLSGSYLFTAIIGGLAWGLIFYPGNWPVIAPLHVPVEYNGMLMSIADIQGYNYVRTGTPEYIRMVEKGTLR

SEQ ID NO: 54 - protein, 151 aa, Methylocaldum  E10_A
RLWVTVTPIVLVTFPAAIQAWTWERFRNPWGATMAVLALLFGEWVNRYFNFWGWTYFPINFVFPAILVPGAILLDTFLMLSGSYLFTAIVGGMAWGLIFYPGNWPMIAPLHVPVEYNGMLMSIADLQGYHYVRTGTPEYIRMVEKGTLRTF

SEQ ID NO: 55 - protein, 174 aa, Methylocaldum  ML100
DWDFCSDWKDRRLWVTVTPIVLVTFPAAIQAWAWEKFRNPWGATIAVLALLFGEWVNRYFNFWGWTYFPINFVFPAVLVPGAILLDTFLMLSGSYLFTAIVGGMAWGLVFYPGNWPMIAPLHVPVEYNGMLMSIADIQGYNYVRTGTPEYIRMVEKGTLRTFGKDVAPVSSFFS

SEQ ID NO: 56 - protein, 174 aa, Methylocaldum  ML184; identical to SEQ ID NO: 55

SEQ ID NO: 57 - protein, 174 aa, Methylocaldum  ML39
  VARIANT (1)...(174): Xaa = Any Amino Acid
DWDFCSDWKDRRLWVTVTPIVLVTFPAAIQAWAWEKFRNPWGATIAVLALLFGEWVNRYFNFWGWTYFPINFVFPAVLVPGAILLDTFLMLSGSYLLTAIVGDMAWGLVFYPGNWPMIAPLHVPVEYNGMLMSIADIQGYNHVRTGTPEYIRMVEKGTLRTFGKDVXPVSSXFS

SEQ ID NO: 58 - protein, 174 aa, Methylocaldum  ML65
  VARIANT (1)...(174): Xaa = Any Amino Acid
DWDFCSDWKDRRLWVTVTPIVLVTFPAAIQAWAWEKFRNPWGATIAVLALLFGEWVNRYFNFWGWTYFPINFVFPAVLVPGAILLDTFLMLSGSYLFTAIVGGMAWGLVFYPGNWPMIAPLHVPVEYNGMLMSIADIQGYNYVRTGTPEYXRMVEKGTLRTFGKDVAPVSSFFS

SEQ ID NO: 59 - protein, 262 aa, Methylocaldum  T-025
MAATTVGGVEAQDKPLLDVKWLTFAFLLYTVFYLWVRWYEGVYGWSAGLDSFAPEFETYWMNFLYTEIVLEVVTASILWGYLWKTRDRNMAALAPREELRRNMTHLIWLFAYAWAIYWGASYFTEQDGTWHQTIVRDTDFTPSHIIEFYLSYPIYIITGGGAFLYAHTRLPYFQTTTKGLSLAYLILWTGPFMILPNVGLNEWGHTFWFMEELFVAPLHYGFVIFGWLALAIMGVLLQIFASVSNLMGKEICEAVDQGLIAK

SEQ ID NO: 60 - protein, 247 aa, Methylocaldum  T-025
MSALQSAVRSHAEAVQVSRTIDYLGLFIFFFVVCGSYHIHAMLTMGDWDFWADWKDRRLWVTVTPIVLITFPAAIQAWAWEKFRNPWGATIAVLALLFGEWVNRYFNFWGWTYFPINFVFPALLVPGAILLDTFLMLSGSYLFTAIVGGLAWGLIFYPSNWPMIAPLHVPVEYNGMLMSIADIQGYHYVRTGTPEYIRMVEKGTLRTFGKDVAPVSAFFSAFMSILIYFMWHFVGRWFSTVRFLKQT

SEQ ID NO: 61 - protein, 418 aa, Methylocaldum  T-025
MKLIKDRIAKWSMVGLLATFAATSFYAPSASAHGEKSQAAFMRMRTIHWYDLNWSKEKVKVNEEVEITGKFHVFEGWPETVAEPDTAFLNVGIPGPVFIRKASYIGGQLVPRSVRLEIGKTYDFKVVLKARRPGDWHVHTMMNVEGGGPIIGPGKWITIEGSMSEFKNPVTTLTGQTVDLETYNEGNTYFWHGASGSAIGMCLGWWYWGTVVRRFLPRLPDGRSGSCERADFGGVTKKVAMGFAAATILIVIFAMSSANSKYPITIPLQAGTLRGIQPIEEPKATVAVKVNDASYRVPGRAMRMKLTITNNGDKPVRLGEFYTASVRFLDADVYKDTTGYPEDLLADDGLEVSDNSPIQPGETRTVEVTASDAAWEVYRLSDIIYDPDSRFAGLLFFFDDQGGRQIVQIDAPLIPSFM

SEQ ID NO: 62 - protein, 176 aa, Methylocaldum szegediense
  VARIANT (1)...(176): Xaa = Any Amino Acid
GDWDLWADWKDRRLWVTVTPIVLITFPAAIXAWAWEKFRNPWGATIAVLALLFGEWVNRYFNFWGWTYFPINFVFPALLVPGAILLDTFLMLSGSYLFTAIVGGLAWGLIFYPSNWPMIAPLHVPVEYNGMLMSIADIQGYHYVRTGTPEYIRMVEKGTLRTFGKDVAPVSAFFSA

SEQ ID NO: 63 - protein, 176 aa, Methylocaldum tepidum
  VARIANT (1)...(176): Xaa = Any Amino Acid
GDWDFWSDWKDRRLWVTVTPIVLVTFPAAIQAWAWERFRNPWGATIAVLALLFGEWVDRYFNFWGWTYFPINFVFPAVLVPGAILLDTFLMLSGSYLFTAIVGXMAWGLVFYPGNWPVIAPLHVPVEYNGMLMSIADIQGYNYVRTGTPEYIRMVEKGTLRTFGKDVXPVSAFFSA

SEQ ID NO: 64 - protein, 169 aa, Methylococcaceae KoM1
GDWDFWSDWKDRRLWVTVLPIMAITFPAAVQAVLWWRYRIAFGATLSVLGLIFGEWVNRYFNFWGWTYFPINFVFPSQLIPGAIVLDVILLVSGSMQLTAVVGGLGFGLLFYPGNWPMMAPLHLPVEYNGMMMTLADLSGYHYVRTGMPEYIRMVEKGTLRTFGKDVAP

SEQ ID NO: 65 - protein, 177 aa, Methylococcaceae M200
GDWDFWTDWKDRRLWVTVAPIVAITFPAAVQAMLWWRYRLPFGAVLCILGLLLGEWVNRYLNFWGWTYFPVNFVFPSNLMPGAIVLDVILMLSNSMTLTAVLGGLGFGLLFYPGNWPIIAPLHVPVEYNGMMMTLADLQGYHYVRTGTPEYIRMVEKGTLRTFGKDLAPVSAFFSAF

SEQ ID NO: 66 - protein, 169 aa, Methylococcaceae OS501
GDWDFWSDWKDRRLWVTVTPIVLVTFPAAVQYFLWERFRQPWGATLCVLALLFGEWVNRYFNFWGWTYFPVNFVFPAILTPGAILLDTVLLLSGSYLFTAIIGAMGWGLIFYPGNWPIIAPLHVPVEYNGMLMSIADIQGYNYVRTGTPEYIRMVEKGTLRTFGKDVAP

SEQ ID NO: 67 - protein, 175 aa, Methylococcus capsulatus
VTGELWSDWKDRRLWVTVTPIVLITFPAAVQSYLWERYRLPWGATVCVLGLLLGEWINRYFNFWGWTYFPINFVFPASLVPGAIILDTVLMLSGSYLFTAIVGAMGWGLIFYPGNWPIIAPLHVPVEYNGMLMSIADIQGYNYVRTGTPEYIRMVEKGTLRTFGKDVAPAMGKSY

SEQ ID NO: 68 - protein, 289 aa, Methylococcus capsulatus
MHETKQGGEKRFTGAICRCSHRYNSMEVKMAATTIGGAAAAEAPLLDKKWLTFALAIYTVFYLWVRWYEGVYGWSAGLDSFAPEFETYWMNFLYTEIVLEIVTASILWGYLWKTRDRNLAALTPREELRRNFTHLVWLVAYAWAIYWGASYFTEQDGTWHQTIVRDTDFTPSHIIEFYLSYPIYIITGFAAFIYAKTRLPFFAKGISLPYLVLVVGPFMILPNVGLNEWGHTFWFMEELFVAPLHYGFVIFGWLALAVMGTLTQTFYSFAQGGLGQSLCEAVDEGLIAK

SEQ ID NO: 69 - protein, 289 aa, Methylococcus capsulatus; identical to SEQ ID NO: 68

SEQ ID NO: 70 - protein, 289 aa, Methylococcus capsulatus; identical to SEQ ID NO: 68

SEQ ID NO: 71 - protein, 414 aa, Methylococcus capsulatus
MKTIKDRIAKWSAIGLLSAVAATAFYAPSASAHGEKSQAAFMRMRTIHWYDLSWSKEKVKINETVEIKGKFHVFEGWPETVDEPDVAFLNVGMPGPVFIRKESYIGGQLVPRSVRLEIGKTYDFRVVLKARRPGDWHVHTMMNVQGGGPIIGPGKWITVEGSMSEFRNPVTTLTGQTVDLENYNEGNTYFWHAFWFAIGVAWIGYWSRRPIFIPRLLMVDAGRADELVSATDRKVAMGFLAATILIVVMAMSSANSKYPITIPLQAGTMRGMKPLELPAPTVSVKVEDATYRVPGRAMRMKLTITNHGNSPIRLGEFYTASVRFLDSDVYKDTTGYPEDLLAEDGLSVSDNSPLAPGETRTVDVTASDAAWEVYRLSDIIYDPDSRFAGLLFFFDATGNRQVVQIDAPLIPSFM

SEQ ID NO: 72 - protein, 247 aa, Methylococcus capsulatus
MSAAQSAVRSHAEAVQVSRTIDWMALFVVFFVIVGSYHIHAMLTMGDWDFWSDWKDRRLWVTVTPIVLVTFPAAVQSYLWERYRLPWGATVCVLGLLLGEWINRYFNFWGWTYFPINFVFPASLVPGAIILDTVLMLSGSYLFTAIVGAMGWGLIFYPGNWPIIAPLHVPVEYNGMLMSIADIQGYNYVRTGTPEYIRMVEKGTLRTFGKDVAPVSAFFSAFMSILIYFMWHFIGRWFSNERFLQST

SEQ ID NO: 73 - protein, 289 aa, Methylococcus capsulatus; identical to SEQ ID NO: 68

SEQ ID NO: 74 - protein, 414 aa, Methylococcus capsulatus; identical to SEQ ID NO: 71

SEQ ID NO: 75 - protein, 414 aa, Methylococcus capsulatus; identical to SEQ ID NO: 71

SEQ ID NO: 76 - protein, 247 aa, Methylococcus capsulatus; identical to SEQ ID NO: 72

SEQ ID NO: 77 - protein, 247 aa, Methylococcus capsulatus; identical to SEQ ID NO: 72

SEQ ID NO: 78 - protein, 289 aa, Methylococcus capsulatus; identical to SEQ ID NO: 68

SEQ ID NO: 79 - protein, 289 aa, Methylococcus capsulatus; identical to SEQ ID NO: 68

SEQ ID NO: 80 - protein, 247 aa, Methylococcus capsulatus
MSAAQSAVRSHAEAVQVSRTIDWMALFVVFFVIVGSYHIHAMLTMGDWDFWSDWKDRRLWVTVTPIVLVTFPAAVQSYLWERYRLPWGATVCVLGLLLGEWINRYFNFWGWTYFPINFVFPASLVPGAIILDTVLMLSGSYLFTAIVGAMGWGLIFYPGNWPIIAPLHVPVENNGMLMSIADIQGYNYVRTGTPEYIRMVEKGTLRTFGKDVAPVSAFFSAFMSILIYFMWHFIGRWFSNERFLQST

SEQ ID NO: 81 - protein, 414 aa, Methylococcus capsulatus; identical to SEQ ID NO: 71

SEQ ID NO: 82 - protein, 260 aa, Methylococcus capsulatus
MAATTIGGAAAAEAPLLDKKWLTFALAIYTVFYLWVRWYEGVYGWSAGLDSFAPEFETYWMNFLYTEIVLEIVTASILWGYLWKTRDRNLAALTPREELRRNFTHLVWLVAYAWAIYWGASYFTEQDGTWHQTIVRDTDFTPSHIIEFYLSYPIYIITGFAAFIYAKTRLPFFAKGISLPYLVLVVGPFMILPNVGLNEWGHTFWFMEELFVAPLHYGFVIFGWLALAVMGTLTQTFYRFAQGGLGQSLCEAVDEGLIAK

SEQ ID NO: 83 - protein, 289 aa, Methylococcus capsulatus; identical to SEQ ID NO: 68

SEQ ID NO: 84 - protein, 247 aa, Methylococcus capsulatus; identical to SEQ ID NO: 72

SEQ ID NO: 85 - protein, 414 aa, Methylococcus capsulatus; identical to SEQ ID NO: 71

SEQ ID NO: 86 - protein, 264 aa, Methylococcus capsulatus
MTALSFTLKSPLRQRLDASPLVPDRLLGKSPKEIATLDLQYGNRRIAAADLFDIAGDDAESVRISGSPKLDFAGRGMTRGSLIIDGDAGAYVGMHMKGGRLCVSGSAGLYAACELKGGIVEICGNAGDLLGSALPGNKKGMSEGVVIVRGDAGDRVGDHMRRGSILIEGNAGMYLGARMTAGTIAVRGRIGACAGYAMKRGTLLVYGSPVSNRRHLQRLWFTYPRFPAFAPQRLSGLEYLLLGDSGVPVPGASTGRRPLGPRQG

SEQ ID NO: 87 - protein, 298 aa, Methylococcus capsulatus
MIINGVHIDETSAEAFPMRATRVIVTAQNLKWAHHAAQAMTGFATSVIACGCEAGIERELDPAETPDGRPGVSALLFAMGGKGLAKQLETRAGQCVLTSPTSALFAGIVEGEQIPLGKNLRYFGDGFQISKRIGGKRYWRIPVMDGEFLCQETTGMIKAVGGGNFLILAESQPQALAACEAAIEAMRRIPNVIMPFPGGVVRSGSKVGSKYKTLPASTNDAFCPTLKGQTRTELSPEIESVMEIVIDGLSDADIAKAMRAGIEAACGLGAANGIRRISAGNYGGKLGPFLFHLREIMA

SEQ ID NO: 88 - protein, 552 aa, Methylococcus capsulatus
KLTGGTVYDPANGIDGQVRNLFIRDGRIVHSLNGATPDQEYDLRGKVVMAGAIDMHTHIGGGKVTIARNLLPEDHRADPEPRRGLKRAGCGHAAPSTLTTGYRYAEMGYTAGFEPAVLPINARQAHMEMADVPLLDVGGYVMLGSDDFFLRLLSAGSDQKLINDYVAWTIRSAKAIGIKVVNPGGISAFKFNQRMLDLDEKHVYYSVTPRQILKSLARAVHELGVPHPLHVHGCNLGVPGNVETTLNTISGIEGLPMHLTHIQFHSYGVEGDRKFSSGAARIAEAINANKNITIDVGQILFGQTVTASGDSMRQHANAGHAHPDKWVCMDIECDAGCGVVPFKYRDKNFVNALQWCIGLETFLLIDDPWRVFLTTDHPNGAPFTTYPHLIRLLMDKSFRNDMLATINPEAAALSTLGSIDREYSLYEIAIMTRAGAARLLGLTDRGHLGAGAAADITVYTDQADKEKMFTRPDYVFKDGELVVRNGEVVKVVWGNLHTVQPEFDNGIEARLRDYFDRYHTMKLDNFVINDWEIEGDGRSKILVHPCHQGTRS

SEQ ID NO: 89 - protein, 253 aa, Methylococcus capsulatus
MATTTAGGIAAIDRLLLDKKWLVFAIGIYTVFYLWVRWYEGVYGWSAGLDSFAPEFETYWMNFLYTEIVLEIVTASILWGYLWKTRDRNLAALTPREELRRNFTHLVWLVAYAWAIYWGASYFTEQDGTWHQTIVRDTDFTPSHIIEFYLSYPIYIITGFAAFIYAKTRLPFFAKGISLPYLVLVVGPFMILPNVGLNEWGHTFWFMEELFVAPLHYGFVIFGWLALAVMGTLTQTFYSFSHLFERDLCPDIR

SEQ ID NO: 90 - protein, 298 aa, Methylococcus capsulatus
MIINGVHIDETFAEAFPMRATRVIVTAQNLKWAHHAAQAMTGFATSVIACGCEAGIERELDPAETPDGRPGVSALLFAMGGKGLAKQLETRAGQCVLTSPTSALFAGIVEGEQIPLGKNLRYFGDGFQISKRIGGKRYWRIPVMDGEFLCQETTGMIKAVGGGNFLILAESQPQALAACEAAIEAMRRIPNVIMPFPGGVVRSGSKVGSKYKTLPASTNDAFCPTLKGQTRTELSPEIESVMEIVIDGLSDADIAKAMRAGIEAACGLGAANGIRRISAGNYGGKLGPFLFHLREIMA

SEQ ID NO: 91 - protein, 382 aa, Methylococcus capsulatus
HGEKSQAAFMRMRTIHWYDLSWSKEKVKINETVEIKGKFHVFEGWPETVDEPDVAFLNVGMPGPVFIRKESYIGGQLVPRSVRLEIGKTYDFRVVLKARRPGDWHVHTMMNVQGGGPIIGPGKWITVEGSMSEFRNPVTTLTGQTVDLENYNEGNTYFWHAFWFAIGVAWIGYWSRRPIFIPRLLMVDAGRADELVSATDRKVAMGFLAATILIVVMAMSSANSKYPITIPLQAGTMRGMKPLELPAPTVSVKVEDATYRVPGRAMRMKLTITNHGNSPIRLGEFYTASVRFLDSDVYKDTTGYPEDLLAEDGLSVSDNSPLAPGETRTVDVTASDAAWEVYRLSDIIYDPDSRFAGLLFFFDATGNRQVVQIDAPLIPSFM

SEQ ID NO: 92 - protein, 247 aa, Methylococcus capsulatus; identical to SEQ ID NO: 72

SEQ ID NO: 93 - protein, 382 aa, Methylococcus capsulatus; identical to SEQ ID NO: 91

SEQ ID NO: 94 - protein, 247 aa, Methylococcus capsulatus; identical to SEQ ID NO: 72

SEQ ID NO: 95 - protein, 382 aa, Methylococcus capsulatus; identical to SEQ ID NO: 91

SEQ ID NO: 96 - protein, 247 aa, Methylococcus capsulatus; identical to SEQ ID NO: 72

SEQ ID NO: 97 - protein, 247 aa, Methylococcus capsulatus; identical to SEQ ID NO: 72

SEQ ID NO: 98 - protein, 414 aa, Methylococcus capsulatus; identical to SEQ ID NO: 71

SEQ ID NO: 99 - protein, 165 aa, Methylohalobius crimeensis
SDWKDRRLWVTVYPIVMITFPAAVQAVIWERLRLPFGATISILGILLGEWINRYFNFWGWTYFPINFVFPTAAVHMAIFLDVVLMLSSSFLFTAVVGGLGWGLLMYPGNWPVIAPLHVPVEYNGMLMSVADIQGYHYVRTGTPEYIRMVEKGTLRTFGKDVAPVS

SEQ ID NO: 100 - protein, 247 aa, Methylohalobius IT-9
MSTAESVVRSHAEAVQASRWVDYLGLFILFMVLTGSYHIHGMLTMGDWDFWADWKDRRLWVTVYPIVMITFPAAVQAVLWERLRLPWGATVCILGILFGEWVNRYFNFWGWTYFPINFVFPTAAVHMAIFLDVVLMLSSSYLLTAVIGGLGWGLLMYPGNWPIIGPLHVPVEYNGMLMSIADIQGYHYVRTGTPEYIRMVEKGTLRTFGKDVVPVSAFFSGFMSILIYFMWHFVGRWFGTVKFVKKT

SEQ ID NO: 101 - protein, 273 aa, Methylohalobius  IT-9
MAATTQAVGAEQEAPLVHKGWLAFAIGIYTVFYMWVRWYEGVYGWSAGLDSFAPEFETYWMNFLYTEIVAEVVTASVLWGYLWRTRDRNLEAVEGTREELRRNFTHLIWLVAYAWAIYWGASYFTEQDGTWHQTIVRDTDFTPSHIIEFYLSYPIYIITGFAAMIYAHTRLPYFNYQKKGLSLPYLITVVGPFMILPNVGLNEWGHTFWFMEELFVAPLHYGFVVFGWFALSILGLLLQVFASFLNLIGKPLCGEVYDEAVARVGEDQAQWAE

SEQ ID NO: 102 - protein, 414 aa, Methylohalobius IT-9
MKTIRDRLTRWSLVGLLMTLAAAVMYTPAASAHGEKSQAAFLRMRTIHWFDLNWSTDQLKVNEEMEISGKFHVFEGWPESVDPPEVSFLNVGIPGPVFIRKESYIGDTFVPRSVRLEIGNTYTFRVVLKARRGGEWHVHPMLNVQGGGPIIGPGKWVIIEGKLSEFKNPITTLTGQTIDLENYNTANTVFWHVLWYAIGLAWIIYFVRNPVFLPRMVMVNAGRGDELITPTEKKVGMLFGAATILLLIFGYSSTQSKYPVTIPLQAGTLRGIKPIEMPAPSVDVKVDEATYRVPGRAMKMVLTVTNKGDRPVQLCEFMTANVRFMNPEVCEDDTGYPEDLLADEGLTVVPNDPIAPGETKTIEVTASDAAWEVYRLADIIYDPDSRMGGILFFYDDAGNRQMVMIDAPLIPTFM

SEQ ID NO: 103 - protein, 56 aa, Methylomarinum vadi
NVGLNEWGHTFWFMEELFVAPLHYGFVFFGWAALAIMGVVNTEVMAITKLLKKDLA

SEQ ID NO: 104 - protein, 249 aa, Methylomarinum vadi
MSASQSAVRSRAEAVQVSRTFDWMILFTLFTAVLGGYHIHYMLTGGDWDFWSDWKDRRLWVTVAPIVSITFPAAVQACLWWRYRLPIGATISVLALLLGEWINRYMNFWGWTYFPVNFVFPSNLVPGAIVLDVVLMLGGSMTLTAVVGGMAYGLLFYPGNWPIIAPLHVPVEYNGMMMTLADLQGYHYVRTGTPEYIRMVEKGTLRTFGKDVAPVSAFFSAFVSIIIYFLWHFFGRWFAKTDFIADDAS

SEQ ID NO: 105 - protein, 46 aa, Methylomarinum vadi
MKIIKDKVAKLSFVALLVTMTAAIFYTPAASAHGEKSQAAFMRMRT

SEQ ID NO: 106 - protein, 196 aa, Methylomicrobium album
  VARIANT (1)...(196): Xaa = Any Amino Acid
XDWKDRQWWPLVTPLMGITFPAAVQAVLWDKFRLPLGATLCVAALLIGTWVTRIFAYHYWNYFPVNMVLPATMLPGALVLDAILMLSNSFTITAIIGGSAFALLFYPSNWPIFALFHMPVEYANAQLTLADLFGFQYIRTGMPEYLRIIERGTLRTYGQYAAPLAAFCSALLCTLMYALWWYIGKWFATTRYLNKI

SEQ ID NO: 107 - protein, 148 aa, Methylomicrobium album
MKIRITKWVYTIGLIIIGLGGPVQTALAHGEKALEPFIRMRTIQWYDVAWSKQQFKVNEEVTVSGRFHVAEDWPVSVPKPDAAFLNVSTPGPVLIRTERWLNGKPWVNSVALQPGGDYEFKIVLKGRLPGRYHIHPFFNLKDAVSMAP

SEQ ID NO: 108 - protein, 165 aa, Methylomicrobium album
TDWKDRRLWVTVLPIVGITFPAAVQAVVWYRWRLPFGAMLAVLGLLFGEWVNRYFNFWGWTYFPVNFVFPSQFAPGAIVLDVILMLSNSMQLTAVLGGLAYGLLFYPGNWPVIAPLHVPVEYNGMVMTLADLQGYHYVRTGTPEYIRMVEKGTLRTFGKDVAPVS

SEQ ID NO: 109 - protein, 177 aa, Methylomicrobium album
GDWDFWTDWKDRRLWVTVLPIVGITFPAAVQAVVWYRWRLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLRTFGKDVAPVSAFFSAF

SEQ ID NO: 110 - protein, 250 aa, Methylomicrobium alcaliphilum
MAATTESVKADAAEAPLLNKKNIIAGASLYLVFYAWVRWYEGVYGWSAGLDSFAPEFETYWMNFLYIEMVLEVLTASVLWGYIWKSRDRKVMSITPREELRRHFTHWTWLMMYGIAIYFGASYFTEQDGTWHQTIVRDTDFTPSHIIEFYLSYPIYIITGGASFLYAKTRLPTYQQGLSLQYLVVVVGPFMILPNVGLNEWGHTFWFMEELFVAPLHYGFVFFGWSALGVLGVINIELGALSKLLKKDLA

SEQ ID NO: 111 - protein, 247 aa, Methylomicrobium alcaliphilum
MSASQSAVRSRAEAVKVSRTFDYMILFTVFFVVLGGYHIHYMLTGGDWDFWTDWKDRRLWVTVAPIVSITFPAAVQAVLWWRYRIAWGATLCVLGLLLGEWINRYFNFWGWTYFPVNFVFPSNLMPGAIVLDVILMLSNSMTLTAVVGGLAWGLLFYPGNWPIIAPLHVPVEYNGMMMTLADLQGYHYVRTGTPEYIRMVEKGTLRTFGKDVAPVSAFFSGFVSILIYFLWHFFGSWFGSEKFVQAA

SEQ ID NO: 112 - protein, 414 aa, Methylomicrobium alcaliphilum
MKIIKDKVAKLSFVALLVTVTAAMFYTPTASAHGEKSQAAFMRMRTIHWFDLNWSKDQVSVNETMSISGKFHVFAGWPETVDKPEVAFLNIGIPGPVFIRAGSWIGGQLVPRSVSLELGETYEFKVLLKARRPGDWHVHTMMNVQGGGPIIGPGKWVTITGSMGDFKNPITTLTGETIDLETYALDGVYGWHLFWYLLGVAWMVYWCRKPVFIPRRIAVDAGKADSLITPTDKKVGMAFAAGTLAIVAVSMGQANEKYPVTTPLQAGLMRGIKSLELPQPTVSVKVVDASYRVPGRAMQMTLEITNNGDSAVRLAEFNTASVRFLDADVYEDDTNYPDDLLAEEGLSVSDNSPLAPGETRTVDVTASDAAWEVYRLADLIYDPDSRFAGLLFFIDEDGNRQMTMVDAPLIPTFI

SEQ ID NO: 113 - protein, 169 aa, Methylomicrobium buryatense
GDWDFWTDWKDRRLWVTVAPIVSITFPAAVQAVLWWRYRIAWGATLCILGLLLGEWINRYFNFWGWTYFPVNFVFPSNLMPGAIVLDVILVLSNSMTLTAVVGGLAWGLLFYPGNWPIIAPLHVPVEYNGMMMTLADLQGYHYVRTGTPEYIRMVEKGTLRTFGKDVAP

SEQ ID NO: 114 - protein, 525 aa, Methylomicrobium japanense
MAISAATKAATDALKINRAPVSVGAQEVHRWLQSFSWDFEKNRSKYPTKYHMANDTKEQFKLIAKEYARMESVKDERQFGSLQDALTRLDAGNRIHPKWGETMKVASNFLEVGEYNAIAATGMLWDSATAPEQKNGYLAQVLDEIRHTNQCGYVNYYYTKHFHDPAGHNDARRTRTIGPLWKGMKRVFSDGFISGDAVECSINLQLVGEACFTNPLIVAITEWAAANGDEITPTVFLSIETDELRHMANGYQTVVSIANDEAASKYLNTDLNNAFWTQQKYFTPVLGMLFEYGSKFKVEPWVKTWNRWVYEDWGGIWIGRLGKYGVESPRSLRDAKKDAYWAHHDLFLLAYALWPTGFFRLSLPTQEEMDWYEANYPGWYDHYGKIYEEWRARGCEDPNSGFIPLMWFIENNHQIYIDRVSQVPFCPSLCKGASTLRVHELNGKKHSFSDDWGERMWLMEPERYECQNMFEQYAGRELSEVIAEGHGVRSDGKTLIAQPHTDKNGKLWTLDDIKKLNCVFKDPLA

SEQ ID NO: 115 - protein, 392 aa, Methylomicrobium japanense
MSIQVQQGKRGLTDPDMVKQILDAIPDQSLDTQRKMNYFVKPRGRRLSEYEILTCYSQPTPDWIPGGLDWGDWTQKFHGGRPSWGNETTELQSTDWHKHRDPAKRWHAPYVKDKAEEWRYTSRFLEAYSAEGQGRSIDPVWRDEVLNDYLGAFCFNEYGLFNAHSSASRDCLGDTSRMSIAFIGLDKVDNAQMIQLERTFLAKVFPGFPESTEIPKREWTEGKIYKGAREAVQDIWQATYDWNEILWSCHMVYDPLFGQFVRREFFQRLSSYYGDTLTPFFINQMQLYYHQAKDITSDMFFYCLGDDPEFGDYNRRMLRAWTDKWLPRTVQALHDFMGIFENIPEIAGVTSKDAVEAALARVLDDWQTDYADKISYKFNKAEIIKNIMKGYK

SEQ ID NO: 116 - protein, 141 aa, Methylomicrobium japanense
MSLSSNAYGAGIMAKSGKEFADEYFAEENQVVHESNEVVLVLKKSDEINIIVDEILLGDRKDENPTLVVEDRAGYWWLKATGKIEVDCEEVSELLGRTFSVYDFLVDVSSTIGRAFTLGEKFTITSELMGLDRKLEDLKAA

SEQ ID NO: 117 - protein, 167 aa, Methylomicrobium japanense
MANYKIHDNPVRDEWVKKIGALSSLAKGVQFLKDFREQYTTPLRKSFDLELDWGWIELKIEQKLALLKHKEMNDAQILNKNADGTDAQQLANQVLASMDRCNDKWEAEKIHIQFRQQWKPPLMPVNVFQDTDRLLGNKLMELRNANYYDMPLEELRKARGVNVVTLQ

SEQ ID NO: 118 - protein, 82 aa, Methylomicrobium japanense
MKAELFEQKSAMPKDNYDTHGERILLMKDRNYSAYVQDLECMWRWTIYRDNELVQEGCSLSQRSAQEAVDHVMALLCHSQKN

SEQ ID NO: 119 - protein, 345 aa, Methylomicrobium japanense
MTSVHQVRIITQDERDVFFECRNDEDVISAALRQDIYLMASCREGGCATCKGFCSEGDYRMGKVSVQALPPDEEEEGQVLLCRCYPETDIEVEVPYTYDRISFSPEDLCFEAEITEVSQISSNVYRLCLKRIGTNQQIKLAAGQYYELQIPGTETWRSYSPANTENNDGVMEFLIRVLPDGKFSKFLMHDAQIGQTVHLKGPSGVFGLKENGFTPRFFVAGGTGLAPILSMVRHMKAWEEPQQSVIYFGVNTEDEIFYVDELNRLADEMPNLTVRNCVWKATDTWNGEKGSVVDILRRDLVETGAKPDLYLCGPPGMVDATYAVCTEVGIPKEHVYLEKFLPSIS

SEQ ID NO: 120 - protein, 141 aa, Methylomicrobium japanense
MSLICLVYVSLANQSMSDEHLKDMLKKARANNEKHDITGMLLFRDGFFMQALEGEEDLVVALFNKIAQDSRHRDVMLVYKKPIKERSFSQWTMGFNKIDNETLDCMDGFCDFMQKPTPEFFMERASEAEALLNEFKHQIFL

SEQ ID NO: 121 - protein, 99 aa, Methylomicrobium japanense
MKESDFEFIDEMVSQLEGTIENLVQEERRLADKIGHARVEELKCYWQGELEPDEIEEFKGGLDYWDKLIIFTWSRLNRVHETRAMAGRAIMKNNQLKGK

SEQ ID NO: 122 - protein, 559 aa, Methylomicrobium japanense
MTIDVIFNPEASERVLSGIRTVARAASVTFGSSGPSVVIQHRTDGIPPIITRDGVTVAKSIQFEDRVADLGARMLRDVAGSVSREVGDGTTTAIVLAQTLAIESIKSVAAGFHPLQIKQGLEGALAIVEAQLQSMALIYSGLDWLESLAMVATKQEQAASRLLAKAHQELDGKGELSFELGNSREDELEIVDGLRYEQGYLSPYFVTDKDRAEAVLDNPYILLYDREIGDLMDLIPILEQVREQDRSLLIIAENVIDKALTGLLLNHVRGVFRAVAVKPPGFGDRRRDRLNDLAVLTGGQAILEDGLLTLDTIDLSHLGQARRVIINEFTTTIIGASGDPEQIEPLIARLSREADLVRARRPGEGSPTGNMHELEELEERINALSGKNGIFKVGGSTDFEIKERMVRIENAYKSIQAAMAEGVIPGCGIGLYRCIEALREPIADDERQHAVRIMQEALRAPARQLLINAGVNPETVFAVIDSDRDVNITFDTIQNRFGNYLDIGVVDSVKIVRMALRNAVSVITTLITAETVLMHVPDLSIMAGYSPEWAAATREDPRE

SEQ ID NO: 123 - protein, 250 aa, Methylomicrobium japanense
MAATTESVKADAAEAPLLNQKNIIAGASLYLVFYAWVRWYEGVYGWSAGLDSFAPEFETYWMNFLYIEMVLEVLTASILWGYIWKSRDRKVMSITPREELRRHLTHWTWLMMYGIAIYFGASYFTEQDGTWHQTIVRDTDFTPSHIIEFYLSYPIYIITGGASFLYAKTRLPTYQQGLSLQYLVVVVGPFMILPNVGLNEWGHTFWFMEELFVAPLHYGFVFFGWSALGVLGVINIELGALSKLLKKDLA

SEQ ID NO: 124 - protein, 247 aa, Methylomicrobium japanense
MSASQSAVRSRAEAVKVSRTIDYMILFTAFFVVLGGYHIHYMLTGGDWDFWTDWKDRRLWVTVAPIVSITFPAAVQAVLWWRYRIAWGATLCVLGLLLGEWINRYFNFWGWTYFPVNFVFPSNLMPGAIVLDVILMLSNSMTLTAVVGGLAWGLLFYPGNWPIIAPLHVPVEYNGMMMTLADLQGYHYVRTGTPEYIRMVEKGTLRTFGKDVAPVSAFFSGFVSILIYFLWHFFGSWFGSEKFVQGS

SEQ ID NO: 125 - protein, 414 aa, Methylomicrobium japanense
MKIIKDKVAKLSFVALLVSVTAAMFYTPTASAHGEKSQAAFMRMRTIHWFDLNWSKDMVSVNETMSISGKFHVFAGWPETVDKPEVAFLNIGIPGPVFIRAGSWIGGQLVPRSVSLELGETYEFKVLLKARRPGDWHVHTMMNVEGGGPIIGPGKWVTITGSMGDFKNPITTLTGETIDLETYALDGVYGWHLFWYVLGVAWMVYWCRKPVFIPRRIAVDAGKADSLITPTDKKVGMAFAAGTMAIVAISMGQANEKYPVTTPLQAGLMRGIKSLELPQPTVSVKVVDASYRVPGRAMQMTLEITNNGDSAVRLAEFNTASVRFLDADVYEDDTNYPDDLLAEEGLSVSDNSPLAPGETRTVDVTASDAAWEVYRLADLIYDPDSRFAGLLFFIDEDGNRQMTMVDAPLIPTFI

SEQ ID NO: 126 - protein, 165 aa, Methylomicrobium kenyense
FWTDWKDRRLWVTVAPIVSITFPAAVQAVLWWRYRIAWGATLCVLGLLLGEWINRYFNFWGWTYFPVNFVFPSNLMPGAIVLDVILMLSNSMTLTAVVGGLAWGLLFYPGNWPIIAPLHVPVEYNGMMMTLADLQGYHYVRTGTPEYIRMVEKGTLRTFGKDVAP

SEQ ID NO: 127 - protein, 165 aa, Methylomicrobium pelagicum
  VARIANT (1)...(165): Xaa = Any Amino Acid
TDWKDRRLWVTVAPIVAITFPAAVQASLWYRYRLPYGAVLSVLGLLLGEWVNRYLNFWGWTYFPVNFVFPSNLIPGAIVLDAILMLSGSMTFTAVIDGLAFGLLFYPGNWPIIAPLHVPVEYNGMMFTLADLQGYHYVRTGTPEYIRMVEKGTLRTFGKDVXPVS

SEQ ID NO: 128 - protein, 141 aa, Methylomicrobium ProtF04
QAVLWWRYRIAWGATLCILGLLLGEWINRYFNFWGWTYFPVNFVFPSNLMPGAIVLDVILMLSNSMTLTAVVGGLAWGLLFYPGNWPIIAPLHVPVEYNGMMMTLADLQGYHYVRTGTPEYIRMVEKGTLRTFGKDVAPVS

SEQ ID NO: 129 - protein, 157 aa, Methylomonas koyamae
TDWKDRRLWVTVAPIVSITFPAAVQACLWWRYRLPIGATISVVALMVGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTF

SEQ ID NO: 130 - protein, 165 aa, Methylomonas methanica
TDWKDRRLWVTVAPIVSITFPAAVQACLWWIYRLPIGATISVVALMLGEWINRYMNFWGWTYFPVNICFPSNLLPGAIVLDVILMLGNSMTLTAVIGGLAYALLFYPGNWPVIAPLHVPVEYNGMMMTLADLQGYHYVRTGTPEYIRMVEKGTLRTFGKDVAPVS

SEQ ID NO: 131 - protein, 200 aa, Methylomonas methanica
MSASQSAVRSRAEAVQVSRTFDWMILFTLFTAVLGGYHIHYMLTGGDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMV

SEQ ID NO: 132 - protein, 165 aa, Methylomonas methanica
DWDFWSDWKDRRLWVTVTPIVLVTFPAAVQSYLWERYRLPWGATVCVLGLLLGEWINRYFNFWGWTYFPINFVFPASLVPGAIILDTVLMLSGSYLFTAIVGAMGWGLTFYPGNWPIIAPLHVPVEYNGMLMSIADIQGYNYVRTGTPEYIRMVEKGTLRTFGKD

SEQ ID NO: 133 - protein, 119 aa, Methylomonas methanica
GDWDFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGKDVAPVSAFFSAF

SEQ ID NO: 134 - protein, 412 aa, Methylomonas methanica
MKSLFKPWMLALLFLNVLSVLSVPTAQAHGEKALEPFIRMRTIQWYDVQWSTQKFNVNDEVSVSGKFHVAEDWPVSVPKPEASFLNISTPGPVLIRTERYLNGKPWTNSVALEPGGDYDFKVVLKGRLPGRYHIHPFFNLKDAGQVMGPGVWLEIGGNPSDFTNTIKTINGELIDMESFGFANGVFWHLFWGLLAAAWLLWWVRRPLFISRYRMLDAGLEHELITDQDKLIAKAVLVGVPVLVLALNAVTANSYPDAIPLQAGLDRILPLPAKVNAGTVNVDTIKAEYNVAQRAMVLQVSVDNRSQGAVRIGEFSTSNVHFMNADLSAVGNVSGKDDVSNKGLSLDNNAPIEPGEQRTVTIEVRDAAWESEKLDGLIKDADSRLGGLLFLYDDVMGKRYISSISAAVIPKFN

SEQ ID NO: 135 - protein, 250 aa, Methylomonas methanica
MSAQIPISTFKPYRGEKARLARAYDYLILVLALFLFIGSFHLHFALTVGDWDFWVDWKDRQWWPLVTPLIGITFPAAVQAVLWDKFRLPLGATLCVAALLLGTWVTRVFAYHYWNYFPINMVLPATMIPGALVLDTLLMLTYSLTITSIFGGAAFALLFYPTNWPIFGMFHQPVEVANSQLTVADLFGFQYIRTGMPEYLRIIERGTLRTYGQYATPLAAFCSALLCSLMYPLWWYIGKWFANTRYLKKI

SEQ ID NO: 136 - protein, 156 aa, Methylomonas methanica
MATTTEHVSLSTEKPKSLPWYLIDLPKYLKGFGFLTIMYIGLRLYQGAFAIAHGLDSSEPAFEQYWMRLFYIELVIIAAVASGFWGYLWLSRDRQLDQLAPKEEIRRYFTLTMWISIYTFAVYWAGSYFAEQDNSWHQVAIRDTPFTANHIIEFYF

SEQ ID NO: 137 - protein, 250 aa, Methylomonas methanica
MAATTESVKADAAEAPLLNKRNLTLGMLLYLVFYSFIRWYEGVYGWSAGLDSFAPEFETYWMNMLYIEIVCEVILFSGINGYLWKTRDRKVMSITPREELRRHFTHWIWLVCYGWAIYWGASYFTEQDGTWHQTIVRDTDFTPSHIIEFYLSYPIYIITGTAAFMYAKTRLPTYHEGLHLMYLIAVIGPFMILPNVGLNEWGHTFWFMEELFVAPLHYGFVFFGWAALAIMGVVNTEVMAITKLLKKDLA

SEQ ID NO: 138 - protein, 249 aa, Methylomonas methanica
MSASQSAVRSRAEAVQVSRTFDWMILFTLFTAVLGGYHIHYMLTGGDWDFWTDWKDRRLWVTVAPIVSITFPAAVQACLWWRYRLPIGATISVVALMIGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGTLRTFGKDVAPVSAFFSGFVSIIIYFLWHFFGRWFAKTDFIADDAS

SEQ ID NO: 139 - protein, 414 aa, Methylomonas methanica
MKIIKDKVAKLSFVALLITMTAAMFYAPTASAHGEKSQAAFMRMRTIHWFDLNWSKEEVPVNDTMTISGKFLVFAGWPETVDKPEVSFLNIGIPGPVFIRAGSWIGGQLVPRSVSLELGEVYEFKVLLKARRPGDWHVHSMMNVQGGGPIIGPGKWVTITGSMSEFVNPVTTLTGQTINLETYALDNVYFWHAVWFAIAFAWLLFWVKRPIFVPRHIAVSTGKADTLISAGDKKVGMLFAVGTMVIVAASMGATNEKYPVTTPLQAGLLRGMKTYQMPESTVSVKVDDATYRVPGRAMQMTLTITNNGDSAVRLGEFNTAGVRFLDPAVHEDETSYPDDLLAEEGLTVSDNSPLAPGETRTVEVTASDAAWEVYRLADLIYDPDSRFAGLLFFWDENGTRQMVTVDAPLIPSFI

SEQ ID NO: 140 - protein, 250 aa, Methylomonas methanica; identical to SEQ ID NO: 137

SEQ ID NO: 141 - protein, 249 aa, Methylomonas methanica; identical to SEQ ID NO: 138

SEQ ID NO: 142 - protein, 414 aa, Methylomonas methanica; identical to SEQ ID NO: 139

SEQ ID NO: 143 - protein, 142 aa, Methylomonas 83
PFPAAVQACLWWRYRLPVGATLSVVALMVGEWINRYMNFWGWTYFPVNICFPSNLLPGAIVLDVILMMGNSMTLTAVVGGLAYGLLFYPGNWPVIAPLHVPVEYNGWMMTLADLQGYHYVRTGTPEYIRMVEKGTLRTFGKD

SEQ ID NO: 144 - protein, 169 aa, Methylomonas B2Z
GDWDFWTDWKDRRLWVTVAPIVSITFPAAVQACLWWRYRLPVGATLSVVALMIGEWINRYMNFWGWTYFPVNICFPSNLIPGAIVLDTILMLGNSMTLTAVVGGLAYGLLFYPGNWPVIAPLHVPVEYNGMMMTLADLQGYHYVRTGTPEYIRMVEKGTLRTFGKDVNR

SEQ ID NO: 145 - protein, 152 aa, Methylomonas PP39A
TFPAAVQAVLWWRYRLPFGAVVCVLGLLLGEWVNRYLNFWGWTYFPVNFCFPSNLMPGAIVLDVVLMLTNSMTVTAVLGGMAWGLLFYPGNWPVIAPLHVPVEYNGMMMTLADLQGYHYVRTGTPEYIRMVEKGTLRTFGKDVAPVSAFFSA

SEQ ID NO: 146 - protein, 152 aa, Methylomonas  PP39B; identical to SEQ ID NO: 145

SEQ ID NO: 147 - protein, 156 aa, Methylomonas PP39E
TFPAAVQAVLWWRYRLPFGAVVCVLGLLLGEWVNRYLNFWGWTYFPVNSCFPSNLMPGAIVLDVVLMLTNSMTVTAVLGGMAWGLLFYPGNWPVIAPLHVPVEYNGMMMTLADLQGYHYVRTGTPEYIRMVEKGTLRTFGKDVAPVSAFFSAFKGE

SEQ ID NO: 148 - protein, 155 aa, Methylomonas PP39F
PCGCSACLWWRYRLPVGATISVVALMVGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGKDVAPVSAFFSAFKGEF

SEQ ID NO: 149 - protein, 157 aa, Methylomonas PP39G
TFPAAVQAVLWWRYRLPFGAVVCVLGLLLGEWVNRYLNFWGWTYFPVNFCFPSNLMPGAIVLDVVLMLTNSMTVTAVLGGMAWGLLFYPGNWPVIAPLHVPVEYNGMMMTLADLQGYHYVRTGTPEYIRMVEKGTLRTFGKDVAPVSAFFSAFKGEF

SEQ ID NO: 150 - protein, 157 aa, Methylomonas  PP39H; identical to SEQ ID NO: 149

SEQ ID NO: 151 - protein, 157 aa, Methylomonas PP39I; identical to SEQ ID NO: 149

SEQ ID NO: 152 - protein, 27 aa, Methylomonas ProtF01
TAVVGGLAYGLLFYPGNWPIIAPLHVP

SEQ ID NO: 153 - protein, 144 aa, Methylomonas ProtK8
ACGGDTDLPIGATISVVALMLGEWINRYMNFWGWTYFPVNMVFPSNLLPGAIVLDVILMLGNSMTLTAVVGGLAYGLLFYPGNWPVIAPLHVPVEYNGMMMTLADLQGYHYVRTGTPEYIRMVEKGTLRTFGKDVAPVSAFFSA

SEQ ID NO: 154 - protein, 151 aa, Methylomonas D1a
RLWVTVAPIVSITFPAAVQACLWWRYRLPIGATISVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTF

SEQ ID NO: 155 - protein, 168 aa, Methylomonas LC 1
DWDFWTDWKDRRLWVTVAPIVSITFPAAVQACLWWRYRLPVGATLSVVALMIGEWVNRYMNFWGWTYFPVNICFPSNLLPGVIVLDVILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 156 - protein, 169 aa, Methylomonas  LW13
GDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAP

SEQ ID NO: 157 - protein, 250 aa, Methylomonas  LW13
MSAQIPISTFKPYRGEKARLARAYDYLILVLALFLFIGSFHLHFALTVGDWDFWVDWKDRQWWPLVTPLIGITFPAAVQAVLWDKFRLPLGATLCVAALLIGTWVARIFAYHYWNFFPVNMVLPATMVPGALVLDTLLMLTNSLTITSIFGGGAFALLFYPTNWPIFGMFHQAVEYHNSQLTVADLFGFQYIRTGMPEYLRIIERGTLRTYGQYATPLAAFCSALLCSLMYPLWWYIGKWFATTRYLKKI

SEQ ID NO: 158 - protein, 414 aa, Methylomonas LW13
MVMKSLFKPWLLALLCVNVLSIFTVPTAQAHGEKALEPFIRMRTIQWYDVQWSTQKFNVNDEVSVSGKFHVAEDWPISVPKPEATFLNISTPGPVLIRTERYLNGKPWTNSVALEPGGDYEFKVVMKGRLPGHYHIHPFFNLKDAGQVMGPGVWLDIGGDPADFSNTIQTINGEMIDMESFGFANGVFWHLFWGALAAAWLLWWVRRPLFISRYRMLDAGLEHELITARDKVIAKAVLVGIPVLVLVINSVTNSRYPDTIPLQAGLDRILPLPAQVNAGTVNVDTLKAEYNVAQRAMVLQVSVDNRSQGAVRIGEFSSSNVHFMNDDLSEVGNVPGKDDVSNKGLSLNDNTPIAPGEQRTVTIEVRDAAWESEKLDGLIKDADSRVGGLLFLYDDVMGKRYISSISAAVIPKFN

SEQ ID NO: 159 - protein, 216 aa, Methylomonas LW13
MATTTEHVSLSTETPKSLPWYLIDLPKYLKGFGLLAVIYISLRLYQGAFAIAHGLDSTEPAFEQYWMRLFYIELAVLAVVVSGFWGYLWTTRDRNLDQLAPKEEIRRYFTLTMWISIYTFAVYWAGSYFAEQDNSWHQVAIRDTPFTANHIIEFYFNFPLYVILGGCAWLYARTRLPLYAKGISLPLTLAVFGPFMILVSVGFNEWGHTFWFREEF

SEQ ID NO: 160 - protein, 169 aa, Methylomonas  LW15
GDWDFWTDWKDRRLWVTVAPIVSITFPAAVQACLWWRYRLPVGATLSVVALMVGEWINRYMNFWGWTYFPVNICFPSNLLPGAIVLDVILMMGNSMTLTAVVGGLAYGLLFYPGNWPVIAPLHVPVEYNGMMMTLADLQGYHYVRTGTPEYIRMVEKGTLRTFGKDVAP

SEQ ID NO: 161 - protein, 169 aa, Methylomonas LW16; identical to SEQ ID NO: 156

SEQ ID NO: 162 - protein, 169 aa, Methylomonas LW19; identical to SEQ ID NO: 156

SEQ ID NO: 163 - protein, 169 aa, Methylomonas LW21
GDWDFWTDWKDRRLWVTVAPIVSITFPAAVQACLWWRYRLPIGATISVVALMVGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAP

SEQ ID NO: 164 - protein, 177 aa, Methylomonas  M5
GDWDFWTDWKDRRLWVTVAPIVSITFPAAVQACLWWRYRLPLGATLSVLALMLGEWINRYFNFWGWTYFPVNICFPSNLIPGAIVLDVVLLLSNSVTLTAVVGGMAYGLLFYPGNWPIIAPLHVPVEYNGMMMTLADLQGYHYVRTGTPEYIRMVEKGTLRTFGKDVAPVSAFFSAF

SEQ ID NO: 165 - protein, 177 aa, Methylomonas MG30
GDWDFWTDWKDRRLWVTVAPIVSITFPAAVQACLWWRYRLPLGATISVLALLLGEWINRYLNFWGWTYFPVNICFPSNLIPGAIVLDVVLLLGNSMTLTAVVGGLAYGLLFYPGNWPVIAPLHVPVEYNGMMMTLADLQGYHYVRTGTPEYIRMVEKGTLRTFGKDVAPVSAFFSAF

SEQ ID NO: 166 - protein, 168 aa, Methylomonas ML04
DWDFCTDWKDRRLWVTVAPIVSITFPAAVQACLWWRYRLPVGATLSVVALMIGEWINRYMNFWGWTYFPVNICFPSNLLPGAIVLDVILMMGNSMTLTAVVGGLAYGLLFYPGNWPVIAPLHVPVEYNGMMMTLADLQGYHYVRTGTPEYIRMVEKGTLRTFGKDVAP

SEQ ID NO: 167 - protein, 168 aa, Methylomonas  ML64
DWDFCTDWKDRRLWVTVAPIVSITFPAAVQACLWWRYRLPIGATISVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 168 - protein, 169 aa, Methylomonas R4F
GDWDFWTDWKDRRLWVTVAPIVSITFPAAVQACLWWRYRLPVGATLSVVALMIGEWINRYMNFWGWTYFPVNICFPSNLIPGAIVLDTILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 169 - protein, 110 aa, Methylosarcina fibrata
WGNFWGWTYFPVNFVFPSQFVPGAIVLDVILMLSNSMQLTAVIGGLAYGLLFYPGNWPVIAPLHVPVEYNGMVMTLADLQGYHYVRTGTPEYIRMVEKGTLRTFGNDVAP

SEQ ID NO: 170 - protein, 110 aa, Methylosarcina quisquiliarum
WGNFWGWTYFPVNFVFPSNFMPGAIVLDVILMLSNSMQLTAVIGGLGYGLLFYPGNWPVIAPLHVPVEYNGMVMTLADLQGYHYVRTGTPEYIRMVEKGTLRTFGNDVAP

SEQ ID NO: 171 - protein, 176 aa, Methylosoma difficile
DWDFWTDWKDRRLWVTVAPIVSITFPAAVQACLWWRYRLPFGAVVCILGLLLGEWINRYLNFWGWTYFPVNFVFPSNLMPGAIILDVVLLLSNSMVLTAVIGGLAYGLVFYPGNWPIIAPLHVPVEYNGMMMTIADLQGYHYVRTGTPEYIRMVEKGTLRTFGKDVAPVSAFFSAF

SEQ ID NO: 172 - protein, 156 aa, Methylosoma TFB
WADWKDRRLWVTVTPIVLVTFPAAAQVFLWERFRQPWGATIAVLALLLGEWVNRYFNFWGWTYFPVNFVFPAILVPGAILLDTFLMLSGSYLFTAIIGGLAWGLIFYPGNWPVIAPLHVPVEYNGMLMSIADIQGYNYVRTGTPEYIRMVEKGTLR

SEQ ID NO: 173 - protein, 71 aa, Methylothermus subterraneus
NVGLNEWGHTFWFMEELFVAPLHYGFVFFGWFALSIMGLLLQVFASFANLMGRELCGEAVYRGGDAATWPE

SEQ ID NO: 174 - protein, 247 aa, Methylothermus subterraneus
MSTTTSAVRSHAEAVQVSRTVDYLGLFILFFVLTGSYHIHGMLTMGDWDFWADWKDRRLWVTVYPIVMITFPAAVQAVLWERLRLPWGATVCVLGILFGEWVNRYFNFWMWTYFPINFVFPTAAVHMAIFLDVVLMLSGSFLFTAVIGGLGWGLLMYPGNWPIIAPLHVPVEYNGMLMSIADIQGYHYVRTGTPEYIRMVEKGTLRTFGKDVAPVSAFFSGFMSILVYFLWHFVGRWFGTVKFVKRT

SEQ ID NO: 175 - protein, 46 aa, Methylothermus subterraneus
MKTMIDRVARWSLVGLLMTLVTAVMYTPSAYAHGEKSQAAFLRMRT

SEQ ID NO: 176 - protein, 169 aa, Methylovulum miyakonense
GDWDFWTDWKDRRLWVTVAPIVSITFPAAVQAMLWWRYRLPFGAVLCILGLLLGEWINRYLNFWGWTYFPVNFVFPSNLMPGAIVLDVILMLSGSMTLTAVLGGLAYGLLFYPGNWPIIAPLHVPVEYNGMMMTLADLQGYHYVRTGTPEYIRMVEKGTLRTFGKDVAP

SEQ ID NO: 177 - protein, 169 aa, Methylovulum miyakonense; identical to SEQ ID NO: 176

SEQ ID NO: 178 - protein, 216 aa, Methylovulum miyakonense
MYAIPNGLGELSVKNPISCKFEKQLALENNLQSSSWYFWRQPQRTETLDDLSGQGEIWEKNKAGQLFYTRLFYKERVALEFVPGDLAAIGNVASWQQLSSLIEPSTLGRELSLQGKDSLGDIVVEHYSGSIRGVPMEVDWLPSLQLPLRMVKKASEGQTSLTLLECAKEPKWPIKPINKGELDSFRHLDYTDLGDMEDDLMVKHLEQVMGTPHHKH

SEQ ID NO: 179 - protein, 250 aa, Methylovulum miyakonense
MAATTESVKADAAEAPLLNKKNMYLGALVYIILYGWVRWYEGVYGWSAGLDSFAPEFETYWMNFLYIEFVLEVSTAGILWGYIWKTRDRKVMSITPREELRRHFTHWVWLVMYGIAIYYGASYFTEQDGTWHQTIVRDTDFTPSHIIEFYLSYPIYIITGGASFLYAKTRLPAYQQGLSLQYLVSVVGPFMILPNVGLNEWGHTFWFMEELFVAPLHYGFVFFGWAALGVMGVVNTEVASISKLLKKDLA

SEQ ID NO: 180 - protein, 247 aa, Methylovulum miyakonense
MSASQSAVRSRAEAVKASRTFDWLICFTLFFVVLGGYHIHYMLTGGDWDFWTDWKDRRLWVTVAPIVSITFPAAVQAMLWWRYRLPFGAVLCILGLLLGEWINRYLNFWGWTYFPVNFVFPSNLMPGAIVLDVILMLSGSMTLTAVLGGLAYGLLFYPGNWPIIAPLHVPVEYNGMMMTLADLQGYHYVRTGTPEYIRMVEKGTLRTFGKDVAPVSAFFSGFVSILIYFLWHFFGQWFNKTDFVKSS

SEQ ID NO: 181 - protein, 414 aa, Methylovulum miyakonense
MKLLKDKVAKLSFVALLATVTASMFYTPTAAAHGEKSQAAFMRMRTIHWFDLNWSKEEVAVNDTMTISGKFFVFSGWPETVDKPEISFLNIGIPGPVFIRAGSWIGGQLVPRSVSLELGETYDFKVLLKARRPGDWHVHTMLNVKGGGPIIGPGKWVTVTGSMKDFTNPITTLTGETIDLETYNLDNTYFWHAFWYALGLAWMGYWMKKPMFVPRSIAVESGKADSLISGTDRKVAMGFAAGTIAIVAMSMSSTNEQYPVTTPLQAGLLRGIKSIEMPATSVAVKVEDATYRVPGRAMQMTLTITNNGDSAIRLGEFNTAGVRFMDANVAQDETGYPDDLLAEEGLTVSDNSPLAPGQSRTVQVTASDDAWEVYRLADLIYDPDSRFAGLLFFYDEAGKRQLITIDAPLIPTFI

SEQ ID NO: 182 - protein, 627 aa, Methylovulum miyakonense
MLNFKNITLRRGVKVLFANSSFTIHKSQKVGFTGANGAGKSSLFAMVRNEIHPDEGVFSMPPNLEIAHVAQETPAIGRPAIEYVIDGDTELRQLQIELVAAETANDGLKQAELHAILEVIGGYTAQARAARLMDGLGFTPDQEQNAVSSFSGGWRMRLNLAQALMCRSDVLLLDEPTNHLDLDAVIWLQEWLCKYPGTLLLISHDRDFLDTITDHIVHIEQNKAEIYTGNYSAFEKMRSEKLAQQQSAYLKQQREIAHIQSFVDRFKAQATKARQAQSRIKALERMELIALAHVDSPFDFSFPALGRMPNPLLKLDKVDVGYGDKTVIKNVNLSIAPGDRIGLLGPNGAGKSSLIKILAGDMIAKTGVRLDAEALKIGYFAQHQLEQLRLDESPLWHLQQLNKQASEKDLRNFLGGFDFQGDKVLEAVKPFSGGEKARLVLAMLVYQSPNLLLLDEPTNHLDLEMRHALSVALQDFQGAMVVVSHDRHLLRSVTDQLLLVADGKVQNFDGDLDDYRNWLNENKRNEEKTTPIESATVSRKDQRKLDADRRQRHKPLFDASKKAELAVEKYHQEQQQLVQKLSDPSIYEESEKIRLKELLDRKVKVDKALEMAEMAWLEAEEMLELAK

SEQ ID NO: 183 - protein, 202 aa, Methylovulum miyakonense
MGLATLVVITASNALISITRNLIPSQIRIPIFVLLIAALVTLVDILMNAWAHELYKVLGLFIALIVTNCALLGRAEAFASKQPVKEALWDGIMMGIGFLLVLVALGAAREISSTGTLFANASLLLGESFRFLEVTVIPNYQGFLLMALPPGGFIMLAFLIVGKRLIDQKLAYNHTHAGGKAMPEAIIDKETPAPISTISIAD

SEQ ID NO: 184 - protein, 527 aa, Methylovulum miyakonense
MAISAATKAATDALAVNRAPVSVGAQEVHRWMQSFTWDFEKNRTKYSTKYKMANDTKEQFKLIAKEYARMESVKDERQFGSLQDVLTRVDAANRVHPKWNESMKVISNFLEVGEYNAIAATGMLWDSATAPEQKNGYLGQVLDEVRHTNQCGYINYYFAKQGQDAAGHNDARRTRAIGPLWKGMKRVFSDGFISGDAVECSINLQLVGEACFTNPLIVAVTEWASANGDEMTPTVFLSIETDELRHMANGYQTVVSIANDAAASKYLNTDLNNAFWTQQKYFTPVLGMMFEYGSHFKVEPWVKTWNRWVYEDWGGIWIGRLGKYGVQSPASLRDAKKDAYWAHHDLFMIAYALWPTGFFRLTLPTAEEAEWYEANHPGWYDMYGKVYEEWKARGCEDPNSGFLPLQWFIENNHPIYIDRVSQVPFCPSYCKGASTLRVLEFNGKKHSFSDQWGERMWLSEPERYECQNIWEQYEGRELSEVIAEGHGVRSDGKTLISQPHTNKDGRLWTLDDIKKINCVFSDPLKAL

SEQ ID NO: 185 - protein, 392 aa, Methylovulum miyakonense
MSIEVSGGRRGLTDPALAATILAAIPDQPLETQRKMNYFMTPRGKRINEYEVLCCYTQPTPDWIPGGLDWGDWTQKFHGGRPSWSNESTEMRSPDWLKHRDPAFRWHALYVKDKAEEWRYTDRFLKAYSADGHVRSMDPIWRDEVLGDYLGAFGFSEYGLFNAHSSVVRDCLGDTLRMSSAMIGLDKVDNAQMIQMERTFLAKLVPGFPESTDIPKNEWTKGTIFKGSREVVQQIWQETYDWNEILFSGHMIYDPLFGQFVRREFFSRLSSYYGDTLTPFFINQMQLYFSQTKGITTDMFHTCLAADGQFGAYNTRLMHVWANKWLPRTITALKGFMGIFSKIPEIKGVTDKPAIEAALNRVFDDWKHDFADPIGYKADTAALIKTVLTGLK

SEQ ID NO: 186 - protein, 141 aa, Methylovulum miyakonense
MTTSSNAYGAGIMAKTGKAFADEYFSEENQTVHESNEVVLVLKKSDEINSVVHEILLGDRKADNPTLIVEDRAGYWWLKATGKIEIDCTEVSELLGKHFSVYDLLVDVSSTIGRAYTLGETFTITSELMGLDVKLQDLQTA

SEQ ID NO: 187 - protein, 165 aa, Methylovulum miyakonense
MPNIHDNPKRAEWANKIAGLKTLAQGHAFLKDFRAQHVSVFKTDFSLELDWLWIELKIEEKVAVLKQAEFSDHQLLNVCTCGTDAQKVANDALAAMAACEDMYEAERIHINFRLACKPPVMPVNVFLDTDRQLGTKLMELRNTDYYALPLEELRKARGVRVVTLQ

SEQ ID NO: 188 - protein, 83 aa, Methylovulum miyakonense
MTVLFDEASAPVGDPPDLSPEAIAIHTSGTYTVYSEDLEFMWRWRIYRDNKMVQEGCSLTLDASRRAVRHVLSFFNVSQLHAQ

SEQ ID NO: 189 - protein, 345 aa, Methylovulum miyakonense
MTSTHQVTIVTEDHESITFDCRSDEDVITAAVRQDIYLMSSCREGGCATCKGYCSEGDYVIGKVSAQALPSQEEEEGMVLLCRCYPTTDIEVEVPYTYERISFSPEGMDFEAEVVGLEQISINVVKFQLRRTGDDKTIKFEAGQFFDLEIPGTETTRSYSPANISNSQGDLEFLIRIVDGGKFSEFLKKEAKVGQRLKAKGPSGVFGLKENGFTPRYFVAGGTGLAPILSMVRHMKEWGEPQKCVIYFGVNTEAEIFHLDELEQLAAQMPTLELRNCVWKCSDDWHCEKGSVVDILRRDLVETGAKPDLYLCGPPGMVDATFAVCADLGIPKERIYLEKFLPSGQ

SEQ ID NO: 190 - protein, 104 aa, Methylovulum miyakonense
MNEADQEFLHDMVKQLDDTIRQLAIEESQLMGKIGAGRVEELLEYWRLELSAEEEVEFKKSMDYWDIQLIRILSRSKRAHNTRVEVGQTLMKMASRPILKRKPS

SEQ ID NO: 191 - protein, 562 aa, Methylovulum miyakonense
MSKEIIYNPEIRVRLMAGINQVARAVAVTYGRVGSTVMIQHRTDGIMPVFTRDGVTVANAVLIQDRIADLGGRMLRDVAGAMSRQVGDGTTTAIVLAQVLAQGCLKSVAAGFHPMQLKKGLDVALAVVEKNLLERAVTGVTSDWVEKIALVASKNETKAGKLLAQAFDELGLQRELTFLLGNGLADELAIVDGVQYGQGYLSPYFITDKTRAEAVLENPYILFYDREINDLMELVPILEQVKAQGRPLLVVAEDVVDKALTGLLLNHIRGIFKVVAVKPPGFGDQRINRLKDLALLTGGQAILDGHGLSLRLEHVGLEQLGQAQRAVITESSTTIIGAVGDPAAIAQLSETLRQEAGLILAKKPGAGSATGNKHDFDELQDRLALLSGKTGTFSVGGNTDFEMKERMVRLENAYLSAKAALEEGVLPGGGVALYHCREAIEKAIAENVGQQQGFRILQQALAAPLLTLIQNAGLNNEAVLNQLDTLGDDHITLDTENHRYGNFLEIGIIDPVKVMRLALRNAVSVVGTLITSETVVMEVPDLSLMAGYSPEWAAATREDPRV

SEQ ID NO: 192 - protein, 592 aa, Methylovulum miyakonense
MFIDLHIHQQDHLAQESLLLRQTSEYQLFRPIQAWQWMTQTRSVPDQSDWVRLEVIESWHRCLEDYRLPLGNYAMWDNCPIVNQTEKLDAPSQKIEALIKQLDHNFHVFLEEAGVMMLLTAADGSLLYSLGERQPTGSFLSRASTRGGNWLEAVLGNNGIGTAAELKKPIAFQGMEHYLSVLHPYTTVGYPLLDDAGQLLAVIGLVSSHHQESMKSLFAFLHLICVLVNTDLPLAKNTLAQQRVLEQIPLKAAPKPPDTLANPSVSEALGGLIQKAVKLQQHKIPILITGESGVGKDHFVMLIKNAGPRKNAPLIAINCASIPHDLIESELFGYESGSFTGAKSTGKPGKFMLADTGILFLDEIGDMSFDLQSTLLRVLETSEFTPVGGNKPIRVDVQVIAATNVQLLEAVEAGRFRRDLYYRLNGAQIHLQPLRERVDKRAIIHHILQREINAMASETRFAICPEVISLFELHPWPGNIRQLINVIRATLYTASNRFITTQDLPLDFIAELKQQNLLDVARVRLPATQNNTQVMRLSDWELHGIKTALKNCGGNISLTAKTLGITRTTLYKKMEHFGLNRTGDESWLYAAI

SEQ ID NO: 193 - protein, 440 aa, Methylovulum miyakonense
MKKITVSLVLSLLPYCAFSDVFQADITVTNSPIDTQKKSFGFNNAENFFDQLTRNGIKQDFNNYSDTSGVKAVTDYQGVLLNINLPQNSSTNELILSIPKLNFTKTFTGPSRSNTTQQLKNYLKSDIDGTATHIVEYQVGNTPNSPLTGNPSSLGGQMVAIGFNNATNIPTTNLPYSSPDTSSSPVSDHNSTGGSHSSSSSANPVIVGVAGGTYTQKGLDISVFNVPISKAFNIDSDDPRKKLLLNGQFNYITVGQAASYQGAVGIGYMHPITDHWYLIPSINYGAIGSQDLASLGQIFSTSLSSNYQFRLPGYDMALVNMFGYYKTLPLNISGVISSNPDINNYVFKNGIFASKVVPFLFGQDVRVKGFFTDTEFTGSKVFIRQYNEVGLELSSVRKVGWLDKISFGLADSLTLSAKYIFSIQDPNNFEGYEIGVGYDF

SEQ ID NO: 194 - protein, 396 aa, Nitrosococcus oceani
MIASSVFYIPTVAAHGEKAQAAFLRMRTIHWYDMVWSKDTIAVNETYTISGKFRVFEDWPEAVEKPHVSFLNAGQPGPVTARLTSYVNGMFVPRSIGLELGGDYEFEMTMQGRRPGTWHVHTLLNVQGGGPLIGPGKYITITGDMADFESKITDLTGNTVNLETMATGTVIGWHLFWYVLGIAWIWWWARRPMFLPRYMRIEAGEANDLVTAQDKKLTIGVLVGVLLIILFGFKSAEDKFPVTIPLQAGLLGTIDSLPVDYNSMVSANVLKANYRVPGRTISMTVEITNHTDQVISIGEFNTGGIRFMNANVRVDETDYPEELLAPEGLEVSQQDIAPGETVVVDISATDAAWEVQRMADVIYDPDSRFAGLIFFVDPEGNEIPIPIGGPLVPTFV

SEQ ID NO: 195 - protein, 247 aa, Nitrosococcus oceani
MSALTSAVRTPEEAAKVSRTLDFIALGAFFMILLASHHVHVMLLMGDWDFWVDWKDRRFWVTVVPIVSVAYPAAAQAFFWEKFRLPFGATLVTLGVLAGEWANRYFNFVGFTYFPINFVWPTILLPMALFLDAMLAISKSYGLTAVVGGLMYGLLMYPANWPLLSAFHVPAEYNGVVMSLADIMGYQYVRTGTPEYIRMIEKGTLRTFGKDVVPVSAFFSGFVAMVMYFVWHFVGRWFSKDYHIDQV

SEQ ID NO: 196 - protein, 261 aa, Nitrosococcus oceani
MAATSRAVAQGVAEKETADLFAWRGMWLAVAAFFAFYICVRWYEGVYGWKYGLDAFSPEFQTYWMNLLYIELVVEALATAALVSYLIKTRDRNMEAMTPREELRRYCTLYMWWVVYGVGLFWGASFFTEQDGAWHQTVVRDTDFTPSHIIEFYMSYPIYVMVGLGSFTYAKTRIPYFAKGWSVPYLMLVFGPFMIFPNVGLNEWGHTFWFMEELFVAPLHWGFVFFAWFILAVFGVFLQVQPRMKELIGRELQQSEDYARS

SEQ ID NO: 197 - protein, 176 aa, Unknown
  thermophilic methanotroph HB
GDWDFWADWKDRRLWVTVYPIVMITFPAAVQAVIWERMRLPWGATVCILGILFGEWVNRYFNFWMWTYFPINFVFPTAAVHMAIFLDVVLMLSGSFLFTAVIGGLGWGLLMYPGNWPIIAPLHVPVEYNGMLMSIADIQGYHYVRTGTPEYIRMVEKGTLRTFGKDVAPVSAFFSA

SEQ ID NO: 198 - protein, 164 aa, unknown
  type I methanotrophic bacterium
DWKDRRLWVTVAPIVSITFPAAVQACLWWRYRLPIGATISVVALMVGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAPVS

SEQ ID NO: 199 - protein, 165 aa, unknown
  type I methanotrophic bacterium
TDWKDRRLWVTVAPIVSITFPAAVQACLWWRYRLPIGATISVVALMVGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAPVS

SEQ ID NO: 200 - protein, 162 aa, unknown
  type I methanotrophic bacterium
TDWKDRRLWVTVAPIVSITFPAAVQACLWWRYRLPIGATISVVALMVGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVP

SEQ ID NO: 201 - protein, 165 aa, unknown
  type I methanotrophic bacterium
SDWKDRRLWVTVTPIVLVTFPAAAQVFLWERFRQPWAATVCVLALLFGEWVNRYFNFWGWTYFPVNFVFPAILVPGAIILDVCLMLSGSHLFTAIIGGLAWGLIFYPGNWPIIAPIHVPVEYNGMLMSIADIQGYNYVRTGTPEYIRMVEKGTLRTFGKDVAPVS

SEQ ID NO: 202 - protein, 165 aa, unknown
  uncultured bacterium FW-1
SDWKDRRLWVTVTPIVLITFPAAVQSYLWERYRQPWGATVCVLGLLLGEWINRYFNFWGWTYFPVNFVFPAILTPGAIILDTMLMLSGSYLFTAVVGAMGWGLIFYPGNWPIIAPIHVPVEYSGMLMSIADIQGYNYVRTGTPEYIRMVEKGTLRTFGKDVAPVS

SEQ ID NO: 203 - protein, 165 aa, unknown
  uncultured bacterium FW-18
SDWKDRRLWVTVTPIVLITFPAAVQYFLWERFRQPWGATVCVLALLFGEWINRYFNFWGWTYFPVNFCFPAIQVPGAILLDVVLLLSGSYLFTAIIGAMAWGLIFYPGNWPIIAPLHVPVEYNGTLMSIADIQGYNYVRTGTPEYIRMVEKGTLRTFGKDVAPVS

SEQ ID NO: 204 - protein, 165 aa, unknown
  uncultured bacterium FW-36
SDWKDRRLWVTVTPIVLITFPAAVQSYLWERYRQPWGATVCVLGLLLGEWINRYFNFWGWTYFPVNFVFPAILTPGAILLDTVLLLSGSYLFTAIIGAMGWGLIFYPGNWPIIAPLHVPVEYSGMLMSIADIQGYNYVRTGTPEYIRMVEKGTLRTFGKDVAPVS

SEQ ID NO: 205 - protein, 165 aa, unknown
  uncultured bacterium FW-47
SDWKDRRLWVTVTPIVLVTFPAAVQYFLWERFRQPWGATVCVLALLFGEWINRYFNFWGWTYFPVNFVFPAILTPGATLLDTVLLLSGSYLFSAIIGAMGWGLIFYPGNWPIMAPLHVPVEYNGMLMSIADIQGYNYVRTGTPEYIRMVEKGTLRTFGKDVAPVS

SEQ ID NO: 206 - protein, 165 aa, unknown
  uncultured bacterium FW-50
ADWKDRRLWVTVTPIVLITFPAAVQSYLWERYRQPWGATVCVLGLLLGEWINRYFNFWGWTYFPVNFVFPAILTPGAILLDTMLMLSGSYLFTAVVGAMGWGLIFYPGNWPIIAPIHVPVEYSGMLMSIADIQGYNYVRTGTPEYIRMVEKGTLRTFGKDVAPVS

SEQ ID NO: 207 - protein, 165 aa, unknown; identical to SEQ ID NO: 203
  uncultured bacterium PS-45

SEQ ID NO: 208 - protein, 165 aa, unknown
  uncultured bacterium PS-49
SDWKDRRLWVTVTPIVLVTFPAAVQYFLWERFRQPWGATVCVLALLFGEWVNRYFNFWGWTYFPVNFVFPAILTPGAILLDTVLLLSGSYLFTAIIGAMGWGLIFYPGNWPIIAPLHVPVEYNGMLMSIADIQGYNYVRTGTPEYIRMVEKGTLRTFGKDVAPVS

SEQ ID NO: 209 - protein, 165 aa, unknown
  uncultured bacterium PS-80
SDWKDRRLWVTVVPIVAITFPAAVQACLWWRYRLPIGATLSVLALLLGEWINRYMNFWGWTYFPINICFPSQLVPGAILLDVILMLGGSMTLTAVAGGLGWGLIFYPSNWPVIAPLHMPVEYNGMMMTLADLSGYHYVRTGTPEYIRMVKKGTLRTFGKDVAPVS

SEQ ID NO: 210 - protein, 165 aa, unknown
  uncultured bacterium WC301-37
SDWKDRRLWVTVTPIVLITFPAAVQSYLWERYRQPWGATVCVLGLLLGEWINRYFNFWGWTYFPVNFVFPAILTPGAILLDTVLLLSGSYLFTAIIGAMGWGLIFYPGNWPIIAPLHVPVEYSGMLMSIADIQGYNYVRTGTPEYTRMVEKGTLRTFGKDAAPVS

SEQ ID NO: 211 - protein, 165 aa, unknown; identical to SEQ ID NO: 204
  uncultured bacterium WC306-17

SEQ ID NO: 212 - protein, 165 aa, unknown
  uncultured bacterium WC306-5
SDWKDRRLWVTVTPIVLITFPAAVQYFLWERFRQPWGATVCVLALLFGEWVNRYFNFWGWTYFPVNFVFPAILTPGAILLDTVLLLSGSYLFTAIIGAMGWGLIFYPGNWPIIAPLHVPVEYNGMLMSIADIQGYNYVRTGTPEYIRMVEKGTLRTFGKDVAPVS

SEQ ID NO: 213 - protein, 139 aa, unknown
  uncultured Crenothrix sp.
YNWGNYRQPFGATLCILALGAGKWIAVYTSWWWWSNYPPNFVMPATAIPGALVLDIILLLTRNWTLTAVIGAWMFAALFYPSNWPIFAYSHTPLVVDGALLSWADYMGFMYVRTGTPEYIRMIEVGSLRTFGGHSTMIS

SEQ ID NO: 214 - protein, 177 aa, unknown
  uncultured gamma proteobacterium
GDWDFWSDWKDRRLWVTVTPIVLVTFPAAVQYFLWERFRQPWGATVCVLALLFGEWINRYFNFWGWTYFPVNFCFPAILVPGAILLDTVLLLSGSYLFTAIVGAMGWGLIFYPGNWPIIAPLHVPVEYNGMLMSIADIQGYNYVRTGTPEYIRMVEKGTLRTFGKDVAPVSAFFSAF

SEQ ID NO: 215 - protein, 177 aa, unknown
  uncultured gamma proteobacterium
GDWDFWSDWKDRRLWVTVTPIVLVTFPAAVQYFLWERFRQPWGATVCVLALLFGEWINRYFNFWGWTYFPVNFCFPAIPVPGAILLDTVLLLSGSYLFTAIVGAMGWGLIFYPGNWPIIAPLHVPVEYNGMLMSIVDIQGYNYVRTGTPEYIRMVEKGTLRTFGKDVAPVSAFFSAF

SEQ ID NO: 216 - protein, 177 aa, unknown
  uncultured gamma proteobacterium
GDWDFWTDWKDRRWWLVVTPVSLITFPAAIQYVLWEKFRLPIGATVCVTALLLGQWVSRTLNFYGWAYFPLNFVWPATLIPGAILLDCVLILTRSYLLTGIFGGMLWGVIFYFANWPMLAAFHLPMNHNGVLLSLADLQGFEYIRTGTPEYIRIIERGTLRTFGKDVTPVSAFFSAF

SEQ ID NO: 217 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRMVEKGTLRTFGKDVAPVSAFFSAF

SEQ ID NO: 218 - protein, 177 aa, unknown
  uncultured gamma proteobacterium
GDWDFWTDWKDRRLWVTVAPIVSITFPAAVQASLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRMVEKGTLRTFGKDVAPVSAFFSAF

SEQ ID NO: 219 - protein, 177 aa, unknown; identical to SEQ ID NO: 217
  uncultured gamma proteobacterium

SEQ ID NO: 220 - protein, 177 aa, unknown
  uncultured gamma proteobacterium
GDWDFWTDWKDRRLWVTVAPIVSITFPVAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRMVEKGTLRTFGKDVAPVSAFFSAF

SEQ ID NO: 221 - protein, 177 aa, unknown; identical to SEQ ID NO: 217
  uncultured gamma proteobacterium

SEQ ID NO: 222 - protein, 177 aa, unknown; identical to SEQ ID NO: 217
  uncultured gamma proteobacterium

SEQ ID NO: 223 - protein, 177 aa, unknown; identical to SEQ ID NO: 217
  uncultured gamma proteobacterium

SEQ ID NO: 224 - protein, 177 aa, unknown; identical to SEQ ID NO: 217
  uncultured gamma proteobacterium

SEQ ID NO: 225 - protein, 177 aa, unknown; identical to SEQ ID NO: 217
  uncultured gamma proteobacterium

SEQ ID NO: 226 - protein, 177 aa, unknown; identical to SEQ ID NO: 217
  uncultured gamma proteobacterium

SEQ ID NO: 227 - protein, 177 aa, unknown; identical to SEQ ID NO: 217
  uncultured gamma proteobacterium

SEQ ID NO: 228 - protein, 177 aa, unknown; identical to SEQ ID NO: 217
  uncultured gamma proteobacterium

SEQ ID NO: 229 - protein, 177 aa, unknown; identical to SEQ ID NO: 217
  uncultured gamma proteobacterium

SEQ ID NO: 230 - protein, 177 aa, unknown; identical to SEQ ID NO: 217
  uncultured gamma proteobacterium

SEQ ID NO: 231 - protein, 177 aa, unknown; identical to SEQ ID NO: 217
  uncultured gamma proteobacterium

SEQ ID NO: 232 - protein, 177 aa, unknown; identical to SEQ ID NO: 217
  uncultured gamma proteobacterium

SEQ ID NO: 233 - protein, 177 aa, unknown; identical to SEQ ID NO: 217
  uncultured gamma proteobacterium

SEQ ID NO: 234 - protein, 177 aa, unknown; identical to SEQ ID NO: 217
  uncultured gamma proteobacterium

SEQ ID NO: 235 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLILYPGNWPMVAPLHIPVEYNGMMFTLADLQGYHYVRTGTPEYIRMVEKGTLRTFGKDVAPVSAFFSAF

SEQ ID NO: 236 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEHNGMMFTLADLQGYHYVRTGTPEYIRMVEKGTLRTFGKDVAPVSAFFSAF

SEQ ID NO: 237 - protein, 177 aa, unknown
  uncultured gamma proteobacterium
GDWDFWTDWKDRRLWVTVAPIVSITSPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRMVEKGTLRTFGKDVAPVSAFFSAF

SEQ ID NO: 238 - protein, 177 aa, unknown; identical to SEQ ID NO: 217
  uncultured gamma proteobacterium

SEQ ID NO: 239 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMFGSYTLTAVLGGMGWGLIFYPGNWPMVAPLHIPVEYNGMMFTLADLQGYHYVRTGTPEYIRMVEKGTLRTFGKDVAPVSAFFSAF

SEQ ID NO: 240 - protein, 177 aa, unknown; identical to SEQ ID NO: 217
  uncultured gamma proteobacterium

SEQ ID NO: 241 - protein, 177 aa, unknown; identical to SEQ ID NO: 217
  uncultured gamma proteobacterium

SEQ ID NO: 242 - protein, 177 aa, unknown; identical to SEQ ID NO: 217
  uncultured gamma proteobacterium

SEQ ID NO: 243 - protein, 177 aa, unknown; identical to SEQ ID NO: 217
  uncultured gamma proteobacterium

SEQ ID NO: 244 - protein, 177 aa, unknown; identical to SEQ ID NO: 217
  uncultured gamma proteobacterium

SEQ ID NO: 245 - protein, 177 aa, unknown; identical to SEQ ID NO: 217
  uncultured gamma proteobacterium

SEQ ID NO: 246 - protein, 177 aa, unknown; identical to SEQ ID NO: 217
  uncultured gamma proteobacterium

SEQ ID NO: 247 - protein, 177 aa, unknown; identical to SEQ ID NO: 217
  uncultured gamma proteobacterium

SEQ ID NO: 248 - protein, 177 aa, unknown; identical to SEQ ID NO: 217
  uncultured gamma proteobacterium

SEQ ID NO: 249 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAVILDVVLMMSGSYTLTAVLGGMGWGLIFYPGNWPMVAPSHIPVEYNGMMFTLADLQGYHYVRTGTPEYIRMVEKGTLRTFGKDVAPVSAFFSAF

SEQ ID NO: 250 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYDGMMFTLADLQGYHYVRTGTPEYIRMVEKGTLRTFGKDVAPVSAFFSAF

SEQ ID NO: 251 - protein, 177 aa, unknown; identical to SEQ ID NO: 217
  uncultured gamma proteobacterium

SEQ ID NO: 252 - protein, 177 aa, unknown
  uncultured gamma proteobacterium
GDWDFWTDWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRMVEKGTLRTFGEDVAPVSAFFSAF

SEQ ID NO: 253 - protein, 177 aa, unknown
  uncultured gamma proteobacterium
GDWDFWADWKDRRLWVTVAPIVSITFPAAVQACLWGRYRIPFGATVCVLGLLFGEWVNRYFNFWGWTYFPMNFVWPSNLVPGAIILDVVLMMSGSYTLTAVLGGMGWGLIFYPGNWPMVAPLHIPVEYNGMMFTLADLQGYHYVRTGTPEYIRVVEKGTLRTFGKDVAPVSAFFSAF

SEQ ID NO: 254 - protein, 177 aa, unknown; identical to SEQ ID NO: 218
  uncultured gamma proteobacterium

SEQ ID NO: 255 - protein, 177 aa, unknown
  uncultured gamma proteobacterium
GDWDFWADWKDRRLWVTVAPIVSITFPAAVQACLWGRYRIPFGATVCVLGLLFGEWVNRYFNFWGWTYFPMNFVWPSNLVPGAIILDVVLMMSGSYTLTAVVGGMGWGLIFYPGNWPMVAPLHIPVEYNGMMFTLADLQGYHYVRTGTPEYIRMVEKGTLRTFGKDVAPVSAFFSAF

SEQ ID NO: 256 - protein, 177 aa, unknown; identical to SEQ ID NO: 217
  uncultured gamma proteobacterium

SEQ ID NO: 257 - protein, 177 aa, unknown; identical to SEQ ID NO: 217
  uncultured gamma proteobacterium

SEQ ID NO: 258 - protein, 177 aa, unknown
  uncultured gamma proteobacterium
GDWDFWTDWKDRRLWVTVAPVVSITFPAAVQACLWWRYRLPVGATLSVVALMIGEWINRYMNFWGWTYFPVNICFPSNLLPGAIVLDVILMLGNSMTLTAVVGGLAYGLLFYPGNWPMIAPLHVPVEYNGMMMTLADLQGYHYVRTGTPEYIRMVEKGTLRTFGKDVAPVSAFFSAF

SEQ ID NO: 259 - protein, 177 aa, unknown
  uncultured gamma proteobacterium
GDWDFWTDWKDRRLWVTVAPIVSITFPAAVQACLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 260 - protein, 177 aa, unknown
  uncultured gamma proteobacterium
GDWDFWTDWKDRRLWVTVAPIVSITFPAAVQACLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADSQGYHYVRTGTPEYIRMVEKGTLRTFGNDVAPVSAFFSAF

SEQ ID NO: 261 - protein, 177 aa, unknown
  uncultured gamma proteobacterium
GDWDFWSDWKDRRLWVTVTPIVLITFPAAVQYFLWERFRQPWGATVCVLALLFGEWINRYFNFWGWTYFPVNFCFPAIQVPGAILLDVVLLLSGSYLFTAIIGAMAWGLIFYPGNWPIIAPLHVPVEYNGTLMSIADIQGYNYVRTGTPEYIRMVEKGTLRTFGKDVAPVSAFFSAF

SEQ ID NO: 262 - protein, 177 aa, unknown
  uncultured gamma proteobacterium
GDWDFWTDWKDRRLWVTVAPIVSITFPAAVQACLWWRYRLPFGAVVCVLGLLLGEWINRYLNFWGWTYFPVNFCFPSNLMPGAIVLDVILMLSGSMTVTAVIGGLAWGLLFYPGNWPIIAPLHVPVEYNGMMMTLADLQGYHYVRTGTPEYIRMVEKGTLRTFGKDVAPVSAFFSAF

SEQ ID NO: 263 - protein, 177 aa, unknown; identical to SEQ ID NO: 261
  uncultured gamma proteobacterium

SEQ ID NO: 264 - protein, 177 aa, unknown; identical to SEQ ID NO: 261
  uncultured gamma proteobacterium

SEQ ID NO: 265 - protein, 177 aa, unknown
  uncultured gamma proteobacterium
GDWDFWTDWKDRRLWVTVAPIVSVTFPAAVQACLWWRYRLPFGAVVCVLGLLLGEWVNRYLNFWGWTYFPVNFCFPSNLIPGAIVLDVVLMLSGSMTLTAVLGGMAWGLLFYPGNWPIIAPLHIPVEYNGMMFTLADLQGYHYVRTGTPEYIRMVEKGTLRTFGKDVAPVSAFFSAF

SEQ ID NO: 266 - protein, 177 aa, unknown
  uncultured gamma proteobacterium
GDWDFWTDWKDRRLWVTVAPIVSITFPAAVQAVLWYRYRLPFGAVICILGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRTGTPEYIRMVEKGTLRTFGKDVAPVSAFFSAF

SEQ ID NO: 267 - protein, 177 aa, unknown; identical to SEQ ID NO: 261
  uncultured gamma proteobacterium

SEQ ID NO: 268 - protein, 177 aa, unknown; identical to SEQ ID NO: 261
  uncultured gamma proteobacterium

SEQ ID NO: 269 - protein, 177 aa, unknown; identical to SEQ ID NO: 265
  uncultured gamma proteobacterium

SEQ ID NO: 270 - protein, 177 aa, unknown; identical to SEQ ID NO: 265
  uncultured gamma proteobacterium

SEQ ID NO: 271 - protein, 177 aa, unknown
  uncultured gamma proteobacterium
GDWDFWTDWKDRRLWVTVTPIVLITFPAAVQYFLWERFRQPWGATVCVLALLFGEWINRYFNLWGWTYFPVNFCFPAIQVPGAILLDVVLLPSGSYLFTAIIGAMAWGLIFYPGNWPIIAPLHVPVEYNGTLMSIADIQGYNYVRTGTPEYIRMVEKGTLRTFGKDVAPVSAFFSAF

SEQ ID NO: 272 - protein, 177 aa, unknown; identical to SEQ ID NO: 261
  uncultured gamma proteobacterium

SEQ ID NO: 273 - protein, 177 aa, unknown; identical to SEQ ID NO: 262
  uncultured gamma proteobacterium

SEQ ID NO: 274 - protein, 177 aa, unknown; identical to SEQ ID NO: 261
  uncultured gamma proteobacterium

SEQ ID NO: 275 - protein, 177 aa, unknown; identical to SEQ ID NO: 261
  uncultured gamma proteobacterium

SEQ ID NO: 276 - protein, 177 aa, unknown
  uncultured gamma proteobacterium
GDWDFWLDWKDRRLWVTVTPIVLITFPAAVQYFLWERFRQPWGATVCVLALLFGEWINRYFNFWGWTYFPVNFCFPAIQVPGAILLDVVLLLSGSYLFTAIIGAMAWGLIFYPGNWPIIAPLHVPVEYNGTLMSIADIQGYNYVRTGTPEYIRMVEKGTLRTFGKDVAPVSAFFSAF

SEQ ID NO: 277 - protein, 177 aa, unknown; identical to SEQ ID NO: 261
  uncultured gamma proteobacterium

SEQ ID NO: 278 - protein, 177 aa, unknown
  uncultured gamma proteobacterium
GDWDFWSDWKDRRLWVTVTPIVLITFPAAVQYFLWERFRQPWGATVCVLALLFGEWINRYFNFWGWTYFPVNFCFPAIQVPGAILLDTVLLLSGSYLFTAIIGAMAWGLIFYPGNWPIIAPLHVPVEYNGMLMSIADIQGYNYVRTGTPEYIRMVEKGTLRTFGKDVAPVSAFFSAF

SEQ ID NO: 279 - protein, 177 aa, unknown; identical to SEQ ID NO: 261
  uncultured gamma proteobacterium

SEQ ID NO: 280 - protein, 177 aa, unknown; identical to SEQ ID NO: 261
  uncultured gamma proteobacterium

SEQ ID NO: 281 - protein, 177 aa, unknown; identical to SEQ ID NO: 276
  uncultured gamma proteobacterium

SEQ ID NO: 282 - protein, 177 aa, unknown
  uncultured gamma proteobacterium
GDWDFWTDWKDRRLWVTVAPIVSITFPVAVQACLWWRYRLPFGAVVCILGLLLGEWVNRYLNFWGWTYFPVNFCFPSNLMPGAIVLDVVLMLSGSMTLTAVLGGMAYGLLFYPGNWPIIAPLHVPVEYNGMMMTLADLQGYHYVRTGTPEYIRMVEKGTLRTFGKDVAPVSAFFSAF

SEQ ID NO: 283 - protein, 177 aa, unknown
  uncultured gamma proteobacterium
GDWDFWTDWKDRRLWVTVAPIVSITFPAAVQACLWWRYRLPFGAVVCVLGLLLGEWVNRYLNFWGWTYFPVNFCFPSNLIPGAIVLDVVLMLSGSMTLTAVLGGMAWGLLFYPGNWPIIAPLHIPVEYNGMMFTLADLQGYHYVRTGTPEYIRMVEKGTLRTFGKDVAPVSAFFSAF

SEQ ID NO: 284 - protein, 177 aa, unknown
  uncultured gamma proteobacterium
GDWDFWTDWKDRRLWVTVAPIVSITFPAAVQACLWWRYRLPFGAVVCILGLLLGEWVNRYLNFWGWTYFPVNFCFPSNLMPGAIVLDVVLMLSNSMTLTAVLGGMAYGLLFYPGNWPIIAPLHVPVEYNGMMMTLADLQGYHYVRTGTPEYIRMVEKGTLRTFGKDVAPVSAFFSAF

SEQ ID NO: 285 - protein, 177 aa, unknown
  uncultured gamma proteobacterium
GDWDFWTDWKDRRLWVTVAPIVSITFPAAVQAVLWWRYRLPFGAVVCILGLLLGEWINRYLNFWGWTYFPVNFCFPSNLMPGAIVLDAILMLTGSMTVTAVIGGLAWGLLFYPGNWPIIAPLHVPVEYNGMMMTLADLQGYHYVRTGTPEYIRMVEKGTLRTFGKDVAPVSAFFSAF

SEQ ID NO: 286 - protein, 177 aa, unknown
  uncultured gamma proteobacterium
GDWDFWTDWKDRRLWVTVAPIVSITFPAAVQACLWWRYRLPFGAVVCVLGLLLGEWVNRYLNFWGWTYFPVNFCFPSNLVPGAIVLDVVLMLSGSMTLTAVLGGMAWGLLFYPGNWPIIAPLHIPVEYNGMMFTLADLQGYHYVRTGTPEYIRMVEKGTLRTFGKDVAPVSAFFSAF

SEQ ID NO: 287 - protein, 177 aa, unknown; identical to SEQ ID NO: 283
  uncultured gamma proteobacterium

SEQ ID NO: 288 - protein, 177 aa, unknown
  uncultured gamma proteobacterium
GDWDFWTDWKDRRLWVTVAPIVSITFPAAVQACLWWRYRLPFGAVVCILGLLLGEWINRYLNFWGWTYFPVNFCFPSNLMPGAIVLDVILMLSGSMTLTAVIGGLAWGLLFYPGNWPIIAPLHVPVEYNGMMMTLADLQGYHYVRTGTPEYIRMVEKGTLRTFGKDVAPVSAFFSAF

SEQ ID NO: 289 - protein, 177 aa, unknown; identical to SEQ ID NO: 285
  uncultured gamma proteobacterium

SEQ ID NO: 290 - protein, 177 aa, unknown
  uncultured gamma proteobacterium
GDWDFWVDWKDRRLWVTVVPISLITFPAAVQVLLWERLRLPWGATVCVLGLLFGEWINRYFNFWGWTYFPITMCFPSQIVPGAILLDVVLLLSGSYLLTAIVGGMAFGLIFYPGNWPVIAPYHVPVEYNGMLLSVADLIGYNYVRTGTPEYIRMVEKGTLRTFGKDVAPVSAFFSAF

SEQ ID NO: 291 - protein, 177 aa, unknown
  uncultured gamma proteobacterium
GDWDFWTDWKDRRLWVTVAPIVSITFPAAVQAVLWWRYRLPFGAVVCILGLLLGEWINRYLNFWGWTYFPVNFCFPSNLMPGAIVLDAILMLSGSMTVTAVIGGLAWGLLFYPGNWPIIAPLHVPVEYNGMMMTLADLQGYHYVRTGTPEYIRMVEKGTLRTFGKDVAPVSAFFSAF

SEQ ID NO: 292 - protein, 177 aa, unknown
  uncultured gamma proteobacterium
GDWDFWSDWKDRRLWVTVTPIVLITFPAAVQAVLWWRYRLPFGAVVCILGLLLGEWINRYLNFWGWTYFPVNFCFPSNLMPGAIVLDVILMLTGSMTVTAVIGGLAYGLLFYPGNWPIIAPLHVPVEYNGMMMTLADLQGYHYVRTGTPEYIRMVEKGTLRTFGKDVAPVSAFFSAF

SEQ ID NO: 293 - protein, 177 aa, unknown
  uncultured gamma proteobacterium
GDWDFWADWKDRRLWVTVTPIVLITFPAAVQYFLWERFRQPWGATVCVPALLFGEWINRYFNFWGWTYFPVNFCFPAIQVPGAILLDVVLLLSGSYLFTAIIGAMAWGLIFYPGNWPIITPLHVPVEYNGTLMSIADIQGYNYVRTGTPEYIRMVEKGTLRTFGKDVAPVSAFFSAF

SEQ ID NO: 294 - protein, 177 aa, unknown; identical to SEQ ID NO: 290
  uncultured gamma proteobacterium

SEQ ID NO: 295 - protein, 177 aa, unknown
  uncultured gamma proteobacterium
GDWDFWADWKDRRLWVTVTPIVLITFPAAVQYFLWERFRQPWGATVCVLALLFGEWINRYFNFWGWTYFPVNFCFPAILVPGAILLDTVLLLSGSYLFTAIIGAMAWGLIFYPGNWPIIAPLHVPVEYNGMLMSIADIQGYNYVRTGTPEYIRMVEKGTLRTFGKDVAPVSAFFSAF

SEQ ID NO: 296 - protein, 177 aa, unknown; identical to SEQ ID NO: 261
  uncultured gamma proteobacterium

SEQ ID NO: 297 - protein, 177 aa, unknown
  uncultured gamma proteobacterium
GDWDFWSDWKDRRLWVTVTPIVLITFPAAVQYFLWERFRQPWGATVCVLALLFGEWINRYFNFWGWTYFPVNFCFPAIQVSGAILLDVVLLLSGSYLFTAIIGAMAWGLIFYPGNWPIIAPLHVPVEYNGTLMSIADIQGYNYVRTGTPEYIRMVEKGTLRTFGKDVAPVSAFFSAF

SEQ ID NO: 298 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 299 - protein, 177 aa, unknown; identical to SEQ ID NO: 259
  uncultured gamma proteobacterium

SEQ ID NO: 300 - protein, 177 aa, unknown; identical to SEQ ID NO: 298
  uncultured gamma proteobacterium

SEQ ID NO: 301 - protein, 177 aa, unknown; identical to SEQ ID NO: 298
  uncultured gamma proteobacterium

SEQ ID NO: 302 - protein, 177 aa, unknown; identical to SEQ ID NO: 298
  uncultured gamma proteobacterium

SEQ ID NO: 303 - protein, 177 aa, unknown; identical to SEQ ID NO: 298
  uncultured gamma proteobacterium

SEQ ID NO: 304 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGAIALDVIMMLSGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 305 - protein, 177 aa, unknown; identical to SEQ ID NO: 298
  uncultured gamma proteobacterium

SEQ ID NO: 306 - protein, 177 aa, unknown; identical to SEQ ID NO: 298
  uncultured gamma proteobacterium

SEQ ID NO: 307 - protein, 177 aa, unknown; identical to SEQ ID NO: 298
  uncultured gamma proteobacterium

SEQ ID NO: 308 - protein, 177 aa, unknown; identical to SEQ ID NO: 298
  uncultured gamma proteobacterium

SEQ ID NO: 309 - protein, 177 aa, unknown
  uncultured gamma proteobacterium
GDWDFWTDRKDRRLWVTVAPIVSITFPAAVQASLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 310 - protein, 177 aa, unknown; identical to SEQ ID NO: 304
  uncultured gamma proteobacterium

SEQ ID NO: 311 - protein, 177 aa, unknown; identical to SEQ ID NO: 298
  uncultured gamma proteobacterium

SEQ ID NO: 312 - protein, 177 aa, unknown; identical to SEQ ID NO: 298
  uncultured gamma proteobacterium

SEQ ID NO: 313 - protein, 177 aa, unknown; identical to SEQ ID NO: 298
  uncultured gamma proteobacterium

SEQ ID NO: 314 - protein, 177 aa, unknown; identical to SEQ ID NO: 298
  uncultured gamma proteobacterium

SEQ ID NO: 315 - protein, 177 aa, unknown; identical to SEQ ID NO: 298
  uncultured gamma proteobacterium

SEQ ID NO: 316 - protein, 177 aa, unknown; identical to SEQ ID NO: 298
  uncultured gamma proteobacterium

SEQ ID NO: 317 - protein, 177 aa, unknown; identical to SEQ ID NO: 298
  uncultured gamma proteobacterium

SEQ ID NO: 318 - protein, 177 aa, unknown; identical to SEQ ID NO: 304
  uncultured gamma proteobacterium

SEQ ID NO: 319 - protein, 177 aa, unknown; identical to SEQ ID NO: 298
  uncultured gamma proteobacterium

SEQ ID NO: 320 - protein, 177 aa, unknown; identical to SEQ ID NO: 298
  uncultured gamma proteobacterium

SEQ ID NO: 321 - protein, 177 aa, unknown; identical to SEQ ID NO: 304
  uncultured gamma proteobacterium

SEQ ID NO: 322 - protein, 177 aa, unknown; identical to SEQ ID NO: 298
  uncultured gamma proteobacterium

SEQ ID NO: 323 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGAIALDVIMMLSGSMTLTAVAGGMAWGLLFYPGNWPVMAPLHVPVEYNGMMMTLADLQGYHYVRTGTPEYISMVEKGTLRTFGKDVAPVSAFFSAF

SEQ ID NO: 324 - protein, 177 aa, unknown; identical to SEQ ID NO: 298
  uncultured gamma proteobacterium

SEQ ID NO: 325 - protein, 177 aa, unknown; identical to SEQ ID NO: 298
  uncultured gamma proteobacterium

SEQ ID NO: 326 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKGVAPVSAFFSAF

SEQ ID NO: 327 - protein, 177 aa, unknown
  uncultured gamma proteobacterium
GDWDFWTDWKDRRLWVTVAPIVSITFPAAVQAMLWWRYRLPFGAVLCILGLLLGEWVNRYLNFWGWTYFPVNFVFPSNLMPGAILLDVILMLSGSMTATAVLGGLAYGLVFYPGNWAIVGPLHVPVEYNGMMMTLADLQGYHYVRTGTPEYIRMVEKGTLRTFGKDVAPVSAFFSAF

SEQ ID NO: 328 - protein, 177 aa, unknown; identical to SEQ ID NO: 304
  uncultured gamma proteobacterium

SEQ ID NO: 329 - protein, 177 aa, unknown; identical to SEQ ID NO: 298
  uncultured gamma proteobacterium

SEQ ID NO: 330 - protein, 177 aa, unknown; identical to SEQ ID NO: 327
  uncultured gamma proteobacterium

SEQ ID NO: 331 - protein, 177 aa, unknown
  uncultured gamma proteobacterium
GDRDFWTDWKDRRLWVTVAPIVSITFPAAVQASLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 332 - protein, 177 aa, unknown
  uncultured gamma proteobacterium
GDWDFWTDWKDGRLWVTVAPIVSITFPAAVQASLWYRYRLPYGAVVCILGLLLGEWVNRYLNFWGWTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 333 - protein, 177 aa, unknown
  uncultured gamma proteobacterium
GDWDFWTDWKDRRLWVTVAPIVSITFPAAVQAVLWWRYRLPFGAVVCILGLLLGEWINRYMNFWGWTYFPVNFCFPSNLMPGAIVLDVVLMMTNSMTITAVIGGMAWGLLFYPGNWPIMAPLHVPVEYNGMMMTLADLQGYHYARTGTPEYIRMVEKGTLRTFGKDVAPVSAFFSAF

SEQ ID NO: 334 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLLPGAIVLDVVLMLSGSMTLTAVIGGLAYGLLFYPGNWPVMAPLHVPVEYNGMMMTLADLQGYHYVRTGTPEYIRMVEKGTLRTFGKDVAPVSAFFSAF

SEQ ID NO: 335 - protein, 177 aa, unknown; identical to SEQ ID NO: 298
  uncultured gamma proteobacterium

SEQ ID NO: 336 - protein, 177 aa, unknown
  uncultured gamma proteobacterium
GDWDFWTDWKDRRLWVTVAPIVSITFPAAVQAVLWWRYRLPFGAVVCILGLLLGEWINRYLNFWGWTYFPVNFVFPSNLMPGAILLDVILMLSGSMTATAVLGGLAYGLVFYPGNWAIVGPLHVPVEYNGMMMTLADLQGYHYVRTGTPEYIRMVEKGTLRTFGKDVAPVSAFFSAF

SEQ ID NO: 337 - protein, 177 aa, unknown; identical to SEQ ID NO: 298
  uncultured gamma proteobacterium

SEQ ID NO: 338 - protein, 177 aa, unknown
  uncultured gamma proteobacterium
GDWDFWTDWKDKRLWVTVAPIVSITFPAAVQASLWYRYRLPYGAVVCILGLLLGERVNRYLNFWGWTYFPVNFVFPSQLIPGAIALDVIMMLGGSMTLTAVAGGMAWGLLFYPGNWPVMAPLHVPVEYNGMMMTLADLQGYHYVRTGAPEYIRMVEKGTLRTFGKDVAPVSAFFSAF

SEQ ID NO: 339 - protein, 177 aa, unknown; identical to SEQ ID NO: 332
  uncultured gamma proteobacterium

SEQ ID NO: 340 - protein, 177 aa, unknown
  uncultured gamma proteobacterium
GDWDFWTDWKDRRLWVTVAPIVSITFPAAVQAVLWWRYRLPFGAVVCILGLLLGEWINRYMNFWGWTYFPVNFCFPSNLMPGAIVLDVVLMMTNSMTITAVIGGMAWGLLFYPGNWPIMAPLHVPVEYNGMMMTLADLQGYHYVRTGTPEYIRMVEKGTLRTFGKDVAPVSAFFSAF

SEQ ID NO: 341 - protein, 177 aa, unknown; identical to SEQ ID NO: 298
  uncultured gamma proteobacterium

SEQ ID NO: 342 - protein, 177 aa, unknown; identical to SEQ ID NO: 298
  uncultured gamma proteobacterium

SEQ ID NO: 343 - protein, 177 aa, unknown; identical to SEQ ID NO: 298
  uncultured gamma proteobacterium

SEQ ID NO: 344 - protein, 177 aa, unknown
  uncultured gamma proteobacterium
GDWDFWTDWNDRRLRVTVAPIVSITFPAAVQASLRYRYRLPHGAVVRILGSLLGERVNRYLNPWGWTHFPVNLVFPPQLIPGAIAPDVIMTLGGCMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 345 - protein, 177 aa, unknown; identical to SEQ ID NO: 298
  uncultured gamma proteobacterium

SEQ ID NO: 346 - protein, 177 aa, unknown; identical to SEQ ID NO: 340
  uncultured gamma proteobacterium

SEQ ID NO: 347 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGRTYFPVNFVFPSQLIPGAIALDVIMMLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 348 - protein, 177 aa, unknown; identical to SEQ ID NO: 304
  uncultured gamma proteobacterium

SEQ ID NO: 349 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGAIALDVIMVLGGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 350 - protein, 177 aa, unknown
  uncultured gamma proteobacterium
GDWDFWSDWKDRRLWVTVTPIVLVTFPAAVQYFLWERFRQPWGATVCVLALLFGEWINRYFNFWGWTYFPVNFCFPAILVPGAILLDTVLLLSGSYLFTAIIGAMGWGLIFYPGNWPIIAPLHVPVEYNGMLMSIADIQGYNYVRTGTPEYIRMVEKGTLRTFGKDVAPVSAFFSAF

SEQ ID NO: 351 - protein, 177 aa, unknown; identical to SEQ ID NO: 298
  uncultured gamma proteobacterium

SEQ ID NO: 352 - protein, 177 aa, unknown; identical to SEQ ID NO: 298
  uncultured gamma proteobacterium

SEQ ID NO: 353 - protein, 177 aa, unknown; identical to SEQ ID NO: 298
  uncultured gamma proteobacterium

SEQ ID NO: 354 - protein, 177 aa, unknown
  uncultured gamma proteobacterium
GDWDFWTDWKDRRLWVTVAPIVSITFPAAVQAVLWWRYRLPFGAVVCILGLLLGEWINRYLNFWGWTYFPVNFVFPSNLMPGAIVLDVVLMLSGSMTVTAVIGGLAYGLLFYPGNWPVMAPLHVPVEYNGMMMTLADLQGYHYVRTGTPEYIRMVEKGTLRTFGKDVAPVSAFFSAF

SEQ ID NO: 355 - protein, 177 aa, unknown; identical to SEQ ID NO: 298
  uncultured gamma proteobacterium

SEQ ID NO: 356 - protein, 177 aa, unknown; identical to SEQ ID NO: 298
  uncultured gamma proteobacterium

SEQ ID NO: 357 - protein, 177 aa, unknown
  uncultured gamma proteobacterium
GDWDFWTDWKDRRLWVTVAPIVSITFPAAVQASLWYRYRLPYGAVVCILGLLLGEWVNRYLNFWGWTYFPVNFVFPSQLIPGANALDVIMMLSGSMTLTAVAGGMAWGLLFYPGNWPVMAPLHVPVEYNGMMMTLADLQGYHYVRTGTPEYIRMVEKGTLRTFGKDVAPVSAFFSAF

SEQ ID NO: 358 - protein, 177 aa, unknown; identical to SEQ ID NO: 327
  uncultured gamma proteobacterium

SEQ ID NO: 359 - protein, 177 aa, unknown; identical to SEQ ID NO: 298
  uncultured gamma proteobacterium

SEQ ID NO: 360 - protein, 177 aa, unknown
  uncultured gamma proteobacterium
GDWDFWIDWKDRRLWVTVVPIVLITFPAAVQVLLWERLRLPYGATVCVLGLLFGEWINRYFNFWGWTYFPITMCFPSQIIPGAILLDVVLLLSGSYLLTAIVGGMAWGLIFYPGNWPVIAPYHVPVEYNGMLMSVADLIGYNYVRTGTPEYIRMVEKGTLRTFGKDVAPVSAFFSAF

SEQ ID NO: 361 - protein, 177 aa, unknown
  uncultured gamma proteobacterium
GDWDFWTDWKDRRLWVTVAPIVSITFPAAVQAMLWWRYRLPFGAVLCILGLLLGEWVNRYLNFWGWTYFPVNFVFPSNLMPGAILLDVILMLSGSMTATAVLGGLAYGLVFYPGNWAIVGPLHAPVEYNGMMMTLADLQGYHYVRTGTPEYIRMVEKGTLRTFGKDVAPVSAFFSAF

SEQ ID NO: 362 - protein, 177 aa, unknown; identical to SEQ ID NO: 304
  uncultured gamma proteobacterium

SEQ ID NO: 363 - protein, 177 aa, unknown; identical to SEQ ID NO: 298
  uncultured gamma proteobacterium

SEQ ID NO: 364 - protein, 177 aa, unknown
  uncultured gamma proteobacterium
GDWDFWTDWKDRRLWVTVAPIVSITFPAAVQAMLWWRYRLPFGAVLCILGLLLGEWVNRYLNFWGWTYFPVNFVFPSNLMPGAILLDVILVLSGSMTATAVLGGLAYGLVFYPGNWAIVGPLHVPVEYNGMMMTLADLQGYHYVRTGTPEYIRMVEKGTLRTFGKDVAPVSAFFSAF

SEQ ID NO: 365 - protein, 177 aa, unknown; identical to SEQ ID NO: 214
  uncultured gamma proteobacterium

SEQ ID NO: 366 - protein, 177 aa, unknown; identical to SEQ ID NO: 298
  uncultured gamma proteobacterium

SEQ ID NO: 367 - protein, 177 aa, unknown; identical to SEQ ID NO: 214
  uncultured gamma proteobacterium

SEQ ID NO: 368 - protein, 177 aa, unknown; identical to SEQ ID NO: 304
  uncultured gamma proteobacterium

SEQ ID NO: 369 - protein, 177 aa, unknown; identical to SEQ ID NO: 361
  uncultured gamma proteobacterium

SEQ ID NO: 370 - protein, 177 aa, unknown
  uncultured gamma proteobacterium
GDWDFWTDWKDRRLWVTVAPIVSITFPAAVQAILWYRYRLPFGAVISILGLLLGEWVNRYLNFWGWTYFPVNFCFPSNLMPGAIVLDAILMLSGSMTLTAVIGGLAWGLLFYPGNWPIIAPLHVPVEYNGMMMTLADLQGYHYVRTGTPEYIRMVEKGTLRTFGKDVAPVSAFFSAF

SEQ ID NO: 371 - protein, 177 aa, unknown; identical to SEQ ID NO: 261
  uncultured gamma proteobacterium

SEQ ID NO: 372 - protein, 177 aa, unknown
  uncultured gamma proteobacterium
GDWDFWSDWKDRRLWVTVTPIVLITFPAAVQYFPWERFRQPWGATVCVLALLFGEWINRYFNFWGWTYFPVNFCSPAIQVPGAILLDVVLLLSGSYLFTAIIGAMAWGLIFYPGNWPIIAPLHVPVEYNGTLMSIADIQGYNYVRTGTPEYIRMVEKGTLRTFGKDVAPVSAFFSAF

SEQ ID NO: 373 - protein, 177 aa, unknown
  uncultured gamma proteobacterium
GDWDFWTDWKDRRLWVTVAPIVSITFPAAVQAVLWYRYRLPFGAVICILGLLLGEWVNRYLNFWGWTYFPVNFCFPSNQMPGAIVLDAILMLSGSMTLTAVLGGLAWGLLFYPGNWPIIAPLHVPVEYNGMMMTLADLQGYHYVRTGTPEYIRMVEKGTLRTFGKDVAPVSAFFSAF

SEQ ID NO: 374 - protein, 177 aa, unknown; identical to SEQ ID NO: 373
  uncultured gamma proteobacterium

SEQ ID NO: 375 - protein, 177 aa, unknown; identical to SEQ ID NO: 295
  uncultured gamma proteobacterium

SEQ ID NO: 376 - protein, 177 aa, unknown; identical to SEQ ID NO: 261
  uncultured gamma proteobacterium

SEQ ID NO: 377 - protein, 177 aa, unknown; identical to SEQ ID NO: 261
  uncultured gamma proteobacterium

SEQ ID NO: 378 - protein, 169 aa, unknown
  uncultured gamma proteobacterium
GDWDFWADWKDRRLWVTVAPIVSITFPAAVQACLWWRYRLPVGATLCVLGLLLGEWINRYMNFWGWTYFPVNFRFPSNLMPGAILLDTILLLGGSMTLTAVVGGLAWGLVFYPGNWPIIAPLRVPVEYNGMMFTLADLQGYHYVRTGTPEYIRMVEKGTLRTFGKDVAP

SEQ ID NO: 379 - protein, 169 aa, unknown
  uncultured gamma proteobacterium
GDWDFWADWKDRRLWVTVAPIVSITFPAAVQACLWWRYRLPVGATLCVLGLLLGEWINRYMNFWGWTYFPVNFCFPSNLMPGAILLDTILLLGGSMTLTAVVGGLAWGLVFYPGNWPIIAPLHVPVEYNGMMFTLADLQGYHYVRTGTPEYIRMVEKGTLRTFGKDVAP

SEQ ID NO: 380 - protein, 169 aa, unknown; identical to SEQ ID NO: 379
  uncultured gamma proteobacterium

SEQ ID NO: 381 - protein, 169 aa, unknown
  uncultured gamma proteobacterium
GDWDFWSDWKDRRLWVTVAPIVSITFPAAVQACLWWRYRLPYGAVVCVLGLLLGEWVNRYLNFWGWTYLPVNICFPSNLIPGAIVLDVILMLSGSMVLTAVLGGMAYGLLFYPGNWPIIAPLRVPVEYNGMMFTLADLQGYHYVRTGTPEYIRMVEKGTLRTFGKDVAP

SEQ ID NO: 382 - protein, 169 aa, unknown
  uncultured gamma proteobacterium
GDWDFWTDWKDRRLWVTVAPIVSITFPAAVQSMLWFRYRLPFGAVVCVLALMLGEWINRYLNFWGWTYFPVNFCFPSNLIPGAIILDVVLMLSSSFVLTAVVGGMAWGLVFYPGNWPIIAPLHVPVEYNGMMFTLADLQGYHYVRTGTPEYIRMVEKGTLRTFGKDVAP

SEQ ID NO: 383 - protein, 167 aa, unknown
  uncultured gamma proteobacterium
GDWDFWSDWKDRRLWVTVTPIVLVTFPAAVQYFLWERFRQPWGATVCVLALLFGEWVNRYFNFWGWTYFPVNFVFPAVLVPGAILLDTVLLLSGSYLFTAIIGSMAWGLIFYPGNWPIMAPLHVPVEYNGMLMSIADIQGYNYVRTGTPEYIRMVEKGTLRTFGKDV

SEQ ID NO: 384 - protein, 167 aa, unknown
  uncultured gamma proteobacterium
GDWDFWSDWKDRRLWVTVTPIVLVTFPAAVQYFLWERFRQPWGATVCVLALLFGEWVNRYFNFWGWTYFPVSFVFPAVLVPGAILLDTVLLLSGSYLFTAIIGSMAWGLIFYPGNWPIMAPLHVPVEYNGMLMSIADIQGYNYVRTGTPEYIRMVEKGTLRTFGKDV

SEQ ID NO: 385 - protein, 166 aa, unknown
  uncultured gamma proteobacterium
GDWDFWADWKDRRLWVTVTPIVLVTFPAAVQYFLWERFRQPWGATVCVLALLFGEWVNRYFNFWGWTYFPVNFCFPAILTPGAILLDAVLMMTGSYLFTAVIGGMAWGLIFYPGNWPIIAPLHVPVEYNGMLMSIADIQGYNYVRTGTPEYIRMVEKGTLRTFGKD

SEQ ID NO: 386 - protein, 167 aa, unknown
  uncultured gamma proteobacterium
GDWDFWSDWKDRRLWVTVTPIVLITFPAAVQYFLWERFRQPWGATVCVLALLFGEWVNRYFNFWGWTYFPVNSVFPAVLVPGAILLDTVLLLSGSYLFTAIIGSMAGGLIFYPGNWPIMAPLHVPVEYNGMLMPIADIQGYNYVRTGTPEYIRMVEKGTLRTFGKDV

SEQ ID NO: 387 - protein, 167 aa, unknown
  uncultured gamma proteobacterium
GDWDFWSDWKDRRLWVTVTPIVLVTLPAAVQYFLWERFRQPWGATVCVLALLFGEWVNRYFNFWGWTYFPVNFVFPAVLVPGAILLDTVLLLSGSYLFTAIIGSMAWGLIFYPGSWPIMAPLHVPVEYNGMLMSIADIQGYNYVRTGTPEYIRMVEKGTLRTFGKDV

SEQ ID NO: 388 - protein, 167 aa, unknown
  uncultured gamma proteobacterium
GDWDFWSDWKDRRLWVTVTPIVLVTFPAAVQYFLWERFRQPWGATVCVLALLFGEWINRYFNFWGWTYFPVNFVFPAILTPGAILLDAVLLLSGSYLFTAIIGAMAWGLIFYPGNWPIIAPLHVPVEYNGMLMSIADIQGYNYVRTGTPEYIRMVEKGTLRTFGKDV

SEQ ID NO: 389 - protein, 167 aa, unknown
  uncultured gamma proteobacterium
GDWDFWADWKDRRLWVTVTPIVLVTFPAAVQYFLWERFRQPWGATVCIPALLFGEWINRYFNFWGWTYFPVNFCFPAILVPGAILLDVVLLLSGSYLFTAVIGAMAWGLIFYPGNWPIIAPLHVPVEYNGMLMSIADIQGYNYVRTGTPEYIRMVEKGTLRTFGKDV

SEQ ID NO: 390 - protein, 167 aa, unknown; identical to SEQ ID NO: 389
  uncultured gamma proteobacterium

SEQ ID NO: 391 - protein, 167 aa, unknown; identical to SEQ ID NO: 383
  uncultured gamma proteobacterium

SEQ ID NO: 392 - protein, 167 aa, unknown; identical to SEQ ID NO: 383
  uncultured gamma proteobacterium

SEQ ID NO: 393 - protein, 167 aa, unknown
  uncultured gamma proteobacterium
GDWDFWSDWKDRRLWVTVTPIVLVTFPAAVQYFLWERFRQPWGATVCVLALLFGEWVNRYFNFWGWTYFPVNFVFPAVLVSGAILLDTVLLLSGSYLFTAIIGSMAWGLIFYPGNWPIMAPLHVPVEYNGMLMSIADIQGYNYVRTGTPEYIRMVEKGTLRTFGKDV

SEQ ID NO: 394 - protein, 167 aa, unknown
  uncultured gamma proteobacterium
GDWDFWSDWKDRRLWVTVTPIVLVTFPAAVQYFLWERFRQPWGATVCVLALLFGEWVNRYFNFWGWTYFPVNSVFPAVLVPGAILLDTVLLLSGSYLFTAIIGSMAWGLIFYPGNWPIMAPLHVPVEYNGMLMSIADIQGYNYVRTGTPEYIRMVEKGTLRTFGKDV

SEQ ID NO: 395 - protein, 167 aa, unknown
  uncultured gamma proteobacterium
GDWDFWSDWKDRRLWVTVTPIVLVTFPAAVQYFLWERFRQPWGATVCVLALLFGEWVNRYFNFWGWTYFPVNFVFPAILTPGAILLDTVLLLSGSYLFTAIIGAMGWGLIFYPGNWPIIAPLHVPVEYNGMLMSIADIQGYNYVRTGTPEYIRMVEKGTLRTFGKDV

SEQ ID NO: 396 - protein, 167 aa, unknown; identical to SEQ ID NO: 383
  uncultured gamma proteobacterium

SEQ ID NO: 397 - protein, 167 aa, unknown
  uncultured gamma proteobacterium
GDWDFWSDWKDRRLWVTVTPIVLVTFPAAVQYFLWERFRQPWGATVCVLALLFGEWVSRYFNFWGWTYFPVNFVFPAVLVPGAILLDTVLLLSGSYLFTAIIGSMAWGLIFYPGNWPIMAPLHVPVEYNGMLMSIADIQGYNYVRTGTPEYIRMVEKGTLRTFGKDV

SEQ ID NO: 398 - protein, 165 aa, unknown
  uncultured gamma proteobacterium
  VARIANT (1)...(165): Xaa = Any Amino Acid
GDWDFWSDWKDRRLWVTVTPIVLVTFPAAVQYFLWERFRQPWGATVCVLALLFGEWVSRYFNFWGWTYFPVNFVFPAVLVPGAILLDTVLLLSGSYLFTAIIGSMAWGLIFYPGNWPIMAPLHVPVEYNGMLMSIADIQGYNYVRXGTPEYIRMVEKGTLRTFXK

SEQ ID NO: 399 - protein, 167 aa, unknown; identical to SEQ ID NO: 395
  uncultured gamma proteobacterium

SEQ ID NO: 400 - protein, 167 aa, unknown
  uncultured gamma proteobacterium
GDWDFWADWKDRRLWVTVTPIVLVTFPAAVQYFLWERFRQPWGATVCVLALLFGEWVNRYFNFWGWTYFPVNFCFPAILTPGAILLDAVLMMTGSYLFTAVIGGMAWGLIFYPGNWPIIAPLHVPVEYNGMLMSIADIQGYNYVRTGTPEYIRMVEKGTLRTFGKDV

SEQ ID NO: 401 - protein, 167 aa, unknown; identical to SEQ ID NO: 395
  uncultured gamma proteobacterium

SEQ ID NO: 402 - protein, 267 aa, unknown
  uncultured gamma proteobacterium
MAATTQAVGAVSEAPLLDKRWLAFAFGIYTVFYLWVRWYEGVYGWSAGLDAFAPEFEKYWMNFLYTEIVLEVTTAALLWGYLWKTRDRNLDALAPREELRRNMTHLIWLVAYAWALYWGASYFTEQDGTWHQTIVRDTDFTPSHIIEFYLSYPIYIITGYASMIYAHTRLPYFDYRKKGLSLPYLITVVGPFMILPNVGLNEWGHTFWFMEELFVAPLHYGFVFFGWFALSIMGLLLQVFASFANLMGRELCGEAVYRGGDAATWPE

SEQ ID NO: 403 - protein, 157 aa, unknown
  uncultured methanotroph type 1
TDWKDRRLWVTVAPIVSITFPAAVQATLWYRFRLPFGAVVAVLGLLLGEWVNRYLNFWGWTYFPVNFCFPSNLMPGAIVLDVVLMLSGSMTLTAVVGGMAWGLLFYPGNWPIIAPLHIPVEYNGMMFTLADLQGYHYVRTGTPEYIRMVEKGTLRTF

SEQ ID NO: 404 - protein, 157 aa, unknown
  uncultured methanotroph type 10
ADWKDRRLWVTVAPIVSITFPAAVQASLWGRYRIPFEATVAILGLLFGEWVNRYFNFWGWTYFPMNFVWPSNLVPGAILLDVILLLSNSYTLTAVVGGLGYGLIFYPGNWPMVAPLHIPVEYNGMMMTLADLQGYHYVRTGTSEYIRMVEKGTLRTF

SEQ ID NO: 405 - protein, 157 aa, unknown
  uncultured methanotroph type 11
TDWKDRRLWVTVLPIVGITFPAAVQAVVWYRWRPPFGAMLAVLGLLFGEWVNRYLDFWGWTYFPVNFVFPSQCVPGAIVLDVILMLSNSMQLTAVLGGLAYGLLFYPGNWPVIAPLHVPVEYNGMVMTLADLQGYHYVRTVTPEYIRMVEKGTLRTF

SEQ ID NO: 406 - protein, 157 aa, unknown
  uncultured methanotroph type 12
TDWKDRRLWVTVAPIVSITFPAAVQATLWYRFRLPYGAVVAVLGLLLGEWVNRYLNFWGWTYFPVNFCFPSNLMPGAIVLDVVLMLSGSMTLTAVVGGMAWGLLFYPGNWPIIAPLHIPVECNGMMFTLADLQGYHYVRTGTPEYIRMVEKGTLRTF

SEQ ID NO: 407 - protein, 157 aa, unknown
  uncultured methanotroph type 13
TDWKDRRLWVTVLPIVGITFPAAVQAVVWYRWRLPFGAMLAVLGLLFGEWVNRYFNFWGWTYFPVNFVFPLQFVPGAIVLDVILMLSNSMQLTAVLGGLAYGLLFYPGNWPVIAPLHVPVEYNGMVMTLADLQGYHYVRTGTPEYIRMVEKGTLRTF

SEQ ID NO: 408 - protein, 157 aa, unknown
  uncultured methanotroph type 2
TDWKDRRLWVTVAPIVSITFPAAVQASLWGRYRIPFGATVSVLGLLFGEWVNRYFNFWGWTYFPMNFVWPSNLAPGAILLDVILLLSNSYTLTAVVGGLGYGLIFYPGNWPMVAPLHIPVEYNGMMMTLADLQGYHYVRTGTPEYIRMVEQGTLRTF

SEQ ID NO: 409 - protein, 157 aa, unknown
  uncultured methanotroph type 3
TDWKDRRLWVTVAPIVSITFPAAVQATLWYRLRLPFGAVVAVLGLLLGEWVNRYLNFWGWTYFPVNFCFPSNLMPGAIVLDVVLMLSGSMTLTAVVGGMAWGLLFYPGNWPIIAPLHIPVEYNGMMFTLADLQGYHYVRTGTPEYIRMVEKGTLRTF

SEQ ID NO: 410 - protein, 157 aa, unknown; identical to SEQ ID NO: 22
  uncultured methanotroph type 4

SEQ ID NO: 411 - protein, 157 aa, unknown
  uncultured methanotroph type 5
TDWKDRRLWVTVLPIVGITFPAAVQAVVWYRWRLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLRTF

SEQ ID NO: 412 - protein, 157 aa, unknown
  uncultured methanotroph type 8
TDWKDRRLWVTVAPIVSITFPAAVQAVLWWRYRLPFGAVVCILGLLLGEWVNRYLNFWGWTYFPVNFCFPSNLMPGAIVLDVILMLTGSMTVTAVIGGLAYGLLFYPGNWPIIAPLHVPVEYNGMMMTLADLQGYHYVRTGTPEYIRMVEKGTLRTF

SEQ ID NO: 413 - protein, 157 aa, unknown; identical to SEQ ID NO: 403
  uncultured methanotroph type 9

SEQ ID NO: 414 - protein, 177 aa, unknown
  uncultured methanotrophic gamma proteobacterium
GDWDFWTDWKDRRLWVTVAPIVSITFPAAVQAMLWWRYRLPLGATICILGLLLGEWVNRYLNFWGWTYFPVNFCFPSNLMPGAIVLDVVLMLSGSMTLTAVLGGMAWGLLFYPGNWPTIAPLHIPVEYNGMMFTLADLQGYHYVRTGTPEYIRMVEKGTLRTFGKDVAPVSAFFSAF

SEQ ID NO: 415 - protein, 177 aa, unknown
  uncultured methanotrophic gamma proteobacterium
GDWDFWVDWKDRRLWVTVTPIVLITFPAAVQATLWERLRLPWGATVCVLGLLFGEWINRYFNFWGWTYFPITMVIPSQIVPGAILLDVALMLSGSYLFTAIVGGMAWGLIFYPGNWPVIAPYHVPVEYNGTLMSIADIIGYNYVRTGTPEYIRMVEKGTLRTFGKDVAPVSAFFSAF

SEQ ID NO: 416 - protein, 177 aa, unknown
  uncultured methanotrophic gamma proteobacterium
GDWDFWVDWKDRRLWVTVTPIVLITFPAAVQATLWERLRLPWGATVCVLGLLFGEWINRYFNFWGWTYFPITMVFPSQIVPGAILLDVALMLSGSYLFTAIVGGMAWGLIFYPGNWPVIAPYHVPVEYNGTLMSIADIIGYNYVRTGTPEYIRMVEKGTLRTFGKDVAPVSAFFSAF

SEQ ID NO: 417 - protein, 169 aa, unknown
  uncultured methanotrophic gamma proteobacterium
GDWDFWSDWKDRRLWVTVTPIVLITFPAAVQSYLWERYRQPWGATVCVLGLLLGEWINRYFNFWGWTYFPVNFVFPAILTPGAIILDTMLMLSGSYLFTAIVGAMGWGLIFYPGNWPIIAPLHVPVEYSGMLMSIADIQGYNYVRTGTPEYIRMVEKGTLRTFGKDVAP

SEQ ID NO: 418 - protein, 169 aa, unknown
  uncultured methanotrophic gamma proteobacterium
GDWDFWADWKDRRLWVTVTPIVLITFPAAVQSYLWERYRQPWGATVCVLGLLLGEWINRYFNFWGWTYFPVNFVFPAILTPGAILLDTMLMLSGSYLFTAVVGAMGWGLIFYPGNWPIIAPIHIPVEYSGMLMSIADIQGYNYVRTGTPEYIRMVEKGTLRTFGKDVAP

SEQ ID NO: 419 - protein, 169 aa, unknown
  uncultured methanotrophic gamma proteobacterium
GDWDFWSDWKDRRLWVTVTPIVLITFPAAVQSYLWERYRQPWGATVCVLGLLLGEWINRYFNFWGWTYFPVNFVFPAILTPGAILLDTMLMLSGSYLFTAIVGAMGWGLIFYPGNWPIIAPIHVPVEYSGMLMSIADIQGYNYVRTGTPEYIRMVEKGTLRTFGKDVAP

SEQ ID NO: 420 - protein, 169 aa, unknown
  uncultured methanotrophic gamma proteobacterium
GDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 421 - protein, 109 aa, unknown
  uncultured Methylobacter sp.
GNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGNDVAP

SEQ ID NO: 422 - protein, 109 aa, unknown
  uncultured Methylobacter sp.
GNFWGWTYFPVNFVFPSNLMPGAIVLDVVLLMSGSMTLTAVVGGLAYGLLFYPGNWPIIAPLHVPVEYNGMMMTLADLQGYHYVRTGTPEYIRMVEKGTLRTFGNDVAP

SEQ ID NO: 423 - protein, 109 aa, unknown
  uncultured Methylobacter sp.
GNFWGWTYFPVNFCFPSNLMPGAIVLDVVLMLSGSMTVTAVIGGMAWGLLFYPGNWPVIAPLHVPVEYNGMMMTLADLQGYHYVRTGTPEYIRIVEKGTLRTFGNDVVP

SEQ ID NO: 424 - protein, 109 aa, unknown
  uncultured Methylobacter sp.
GNFWGWTYFPVNFVFPSNLMPGAIVLDVVLLMSGSMTLTAVVGGLAYGLLFYPGNWPIIAPLHVPVEYNGMMMTLADLQGYHYVRAGTPEYIRMVEKGTLRTFGNDVVP

SEQ ID NO: 425 - protein, 115 aa, unknown
  uncultured Methylobacter sp.
GDWDFWTDWKDRRLWVTVAPIVSITFPAAVQAVLWWRYRLPFGAVVCILGLLLGEWVNRYLNFWGWTYFPVNFCFPSNLMPGAIVLDAILMLTGSVTVTAVVGGLAWGLLFFSNN

SEQ ID NO: 426 - protein, 143 aa, unknown
  uncultured Methylobacter sp.
FWTDWKDRRLWVTVAPIVSITFPAAVQACLWWRYKLPFGAVVCVLGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRTG

SEQ ID NO: 427 - protein, 145 aa, unknown
  uncultured Methylobacter sp.
DWDFWTDWKDRRLWVTVAPIVSITFPAAVQACLWWRYKLPFGAVVCVLGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRT

SEQ ID NO: 428 - protein, 133 aa, unknown
  uncultured Methylobacter sp.
WDFWTDWKDRRLWVTVAPIVAITFPAAVQAMLWWRYRLPFGAVLCILGLLLGEWVNRYLNFWGWTYFPVNFVFPSNLMPGAIVLDVILMLSNSMVLTAVLGGLSFGLLFYPGNWPIIAPLHVPVEYNGMMMNL

SEQ ID NO: 429 - protein, 170 aa, unknown
  uncultured Methylobacter sp.
LGDWDFWTDWKDRRLWVTVAPIVSITFPAAIQACLWWRYKLPFGAVVCVLGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRTGTPEYIRMVEKGTLRTFGKDVAP

SEQ ID NO: 430 - protein, 167 aa, unknown
  uncultured Methylobacter sp.
DFWTDWKDRRLWVTVLPIMGITFPAAVQAVLWWRYRIAFGATLCVLGLLFGEWVNRYFNFWGWTYFPINFVFPSQLIPGAIVLDVVLLVSNSMQLTAVVGGLGFGLLFYPGNWPVMAPLHLPVEYNGMMMTLADLSGYHYVRTGMPEYIRMVEKGTLRTFGKDVAPE

SEQ ID NO: 431 - protein, 151 aa, unknown
  uncultured Methylobacter sp.
DFWTDWKDRRLWVTVAPIVSITFPAAVQAVLWWRYRLPFGAVVCILGLLLGEWVNRYLNFWGWTYFPVNFCFPSNLMPGAIVLDAILMLTGSVTVTAVVGGLAWGLLFYPGNWPIIAPLHVPVEYNGMMMTLADLQGYHYVRTGTPEYIRM

SEQ ID NO: 432 - protein, 165 aa, unknown
  uncultured Methylobacter sp.
DWTDWKDRRLWVTVAPIVSITFPAAVQACLWYRYRLPFGAVVCVLGLLLGEWVNRYLNFWGWTYFPVNFCFPSNLMPGVIVLDVVLMLSNSMTLTAVVGGMAWGLLFYPGNWPIIAPLHIPVEYNGMMFTLADLQGYHYVRTGTPEYIRMVEKGTLRTFGKDVAP

SEQ ID NO: 433 - protein, 168 aa, unknown
  uncultured Methylobacter sp.
DWDFWTDWKDRRLWVTVAPIVSITFPAAVQACLWYRYRLPFGAVVCVLGLLLGEWVNRYLNFWGWTYFPVNFCFPSNLMPGAIVLDVVLMLSNSMTLTAVVGGMAWGLLFYPGNWPIIAPLHIPVEYNGMMFTLADLQGYHYVRTGTPEYIRMVEKGTLRTFGKDVAP

SEQ ID NO: 434 - protein, 166 aa, unknown
  uncultured Methylobacter sp.
  VARIANT (1)...(166): Xaa = Any Amino Acid
DFWTDWKDRRLWVTVLPIVGITFPAAVQAILWWRYRLPFGAVVSVLGLLFGEWVNRYFNFWGWTYFPVNFVFPSNFMPGAIVLDVVLLMTNSMVITAVAGGLGYGLLFYPGNWPIIAPLHVPVEYNGMMTTLADLQGYHYVRTGTPEYIRMVEKGTXRTFGXDVAP

SEQ ID NO: 435 - protein, 168 aa, unknown
  uncultured Methylobacter sp.
GDWDFWTDWKDRRLWVTVLPIVGITFPAAVQAILWWRYRLPFGAVVSVLGLLFGEWVNRYFNFWGWTYFPVNFVFPSNFMPGAIVLDVVLLMTNSMIITAVAGGLGYGLLFYPGNWPVIAPLHVPVEYNGMMMTLADLQGYHYVRTGTPEYIRMVEKGTLRTFGKDVG

SEQ ID NO: 436 - protein, 169 aa, unknown
  uncultured Methylobacter sp.
GDRDFWTDWKDRRLWVTVAPIVSITFPAAVQACLWYRYRLPFGAVVCVLGLLLGEWVNRYLNFWGWTYFPVNFCFPSNLMPGAIALDVVLMLSNSMTLTAVVGGMAWGLLFYPGNWPIIAPLHIPVEYNGKMFTLADLQGYHYVRTGTPEYIRMVEKGTLRIFGKDVAP

SEQ ID NO: 437 - protein, 169 aa, unknown
  uncultured Methylobacter sp.
GDWDFWTDWKDRRLWVTVLPIVGITFPAAVQAILWWRYRLPFGAVVSVLGLLFGEWVNRYFNFWGWTYFPVNFVFPSNFMPGAIVLDVVLLMTNSMIITAVAGGLGYGLLFYPGNWPVIAPLHIPVEDNGMMFTLADLQGYHYVRTGTPEYIRMVEKGTLRTFGKDVAP

SEQ ID NO: 438 - protein, 169 aa, unknown
  uncultured Methylobacter sp.
GDWDFSTDWKDRRLWVTVAPIVSITFPAAVQACLWYRYRLPFGAVVCVLGLLLGEWVNRYFNFWGWTYFPVNFCFPSNLVPGAIVLDVVLMLSNSMTLTAVVGGMAWGLLFYPGNWPIIAPLHIPVEYNGMMFTLADLQGYHYVRTGTPEYIRMVEKGTLRTFGKDVAP

SEQ ID NO: 439 - protein, 169 aa, unknown
  uncultured Methylobacter sp.
  VARIANT (1)...(169): Xaa = Any Amino Acid
GDWDFWTDWKDRRLWXTVAPIVSITFPAAVQACLWYRYRLPFGAVVCVLGLLLGEWVNRYLNFWGWTYFPVNFCFPSNLVPGAIVLDVILMLSNSMTLTAVVGGMAWGLLFYPGDWPIIAPLHIPVEYNGMMFTLADLQGYHYVRTGTPEYIRMVEKGTLRTFGKDVAP

SEQ ID NO: 440 - protein, 169 aa, unknown
  uncultured Methylobacter sp.
GDWDFWTDWKDRRLWVTVLPIVGITFPAAVQAILWWRYRLPFGAVVSVLGLLFGEWVNRYFNFWGWTYFPVNFVFPSNFMPGAIVLDVVLLMTNSMIITAVAGGLGYGLLFYPGNWPVIAPLHVPVEYNGMMMTLADLQGYHYVRTGTPEYIRMVEKGTLRTFGKDVAP

SEQ ID NO: 441 - protein, 169 aa, unknown
  uncultured Methylobacter sp.
GDWDFWTDWKDRRLWVTVAPIVSITFPAAVQAILRYRYRLPFGAVIAILGLLLGEWVNRYLNFWGWTYFPVNFCFPSNLMPGAIVLDCILMLSGSMTLTAVVGGLAWGLLFYPGNWPIIAPLHVPVEYNGMMMTLADLQGYHYVRTGTPEYIRMVEKGTLRTFGKDVAP

SEQ ID NO: 442 - protein, 169 aa, unknown
  uncultured Methylobacter sp.
GDWDFWTDWKDRRLWVTVAPIVSITFPAAVQAILWYRYRLPFGAVIAILGLLLGEWVNRYLNFWGWTYFPVNFCFPSNLMPGAIVLDCILMLSSSMTLTAVVGGLAWGLLFYPGNWPIIAPLHVPVEYNGMMMTLADLQGYHYVRTGTPEYIRMVEKGTLRTFGKDVAP

SEQ ID NO: 443 - protein, 166 aa, unknown
  uncultured Methylobacter sp.
DFWTDWKDRRLWVTVAPIVSITFPAAVQAILWYRYRLPFGAVIAILGLLLGEWVNRYLNFWGWTYFPVNFCFPSNLMPGAIVLDCILMLSGSMTLTAVVGGLAWGLLFYPGNWPIIAPLHVPVEYNGMMMTLADLQGYHYVRTGTPEYIRMVEKGTLRTFGKDVAP

SEQ ID NO: 444 - protein, 169 aa, unknown
  uncultured Methylobacter sp.
GDWDFWTDWKDRRLWVTVAPIVSITFPAAVQAILWYRYRLPFGAVIAILGLLLGEWVNRYLNFWGWTYFPVNFCFPSNLMPGAIVLDCILMLSGSMTLTAVIGGLAWGLLFYPGNWPIIAPLHVPVEYNGMMMTLADLQGYHYVRTGTPEYIRMVEKGTLRTFGKDVAP

SEQ ID NO: 445 - protein, 169 aa, unknown
  uncultured Methylobacter sp.
GDWDFWTDWKDRRLWVTVAPIVSITFPAAVLAILWYRYRLPFGAVISILGLLLGEWVNRYLNFWGWTYFPVNFCFPSNLMPGAIVLDCTLMLSGSMTLTAVIGGLAWGLLFYPGNWPIIAPLHVPVEYNGMMMTLADLQGYHYVRTGTPEYIRMVEKGTLRTFGKDVAP

SEQ ID NO: 446 - protein, 169 aa, unknown
  uncultured Methylobacter sp.
GDWDFWTDWKDRRLWVTVAPIVSITFPAAVQAILWYRYRLPFGAVIAILGLLLGEWVNRYLNFWGWTYFPVNFCFPSNLMPGAIVLDCILMLSGSMTLTAVIGGLAWGLLFYPGNWLIIAPLHVPVEYNGMMMTLADLQGYHYVRTGTPEYIRMVEKGTLRTFGKDVAP

SEQ ID NO: 447 - protein, 169 aa, unknown; identical to SEQ ID NO: 444
  uncultured Methylobacter sp.

SEQ ID NO: 448 - protein, 169 aa, unknown
  uncultured Methylobacter sp.
GDWDFWTDWKDRRLWVTVAPIVSITFPAAVQAILWYRYRLPFGAVICILGLLLGEWVNRYLNFWGWTYFPVNFCFPSNLMPGAIVLDAILMLSGSMTVTAVIGGLAWGLLFYPGNWPIIAPLHVPVEYNGMMMTLADLQGYHYVRTGTPEYIRMVEKGTLRTFGKDVAP

SEQ ID NO: 449 - protein, 169 aa, unknown
  uncultured Methylobacter sp.
GDWDFWTDWKDRRLWVTVAPIVSITFPAAVQAILWYRYRLPFGAVIAILGLLLGEWVNRYLNFWGWTYFPVNFVFPSNLMPGAIVLDVILMLSNSMVLTAVVGGLAWGLLFYPGNWPIIAPLHVPVEYNGMVMTLADLQGYHYVRTGTPEYIRMVEKGTLRTFGKDVAP

SEQ ID NO: 450 - protein, 169 aa, unknown
  uncultured Methylobacter sp.
GDWDFWTDWKDRRLWVTVAPIVSITFPAAVQAILWYRYRLPFGAVICILGLLLGEWVNRYLNFWGWTYFPVNFCFPSNLMPGAIVLDVILMLSNSMVLTAVIGGLAWGLLFYPGNWPIIAPLHVPVEYNGMMMTLADLQGYHYVRTGTPEYIRMVEKGTLRTFGKDVAP

SEQ ID NO: 451 - protein, 169 aa, unknown
  uncultured Methylobacter sp.
GDWDFWTDWKDRRLWVTVAPIVSITFPAAVQAVLWYRYRLPFGAVICALGLLLGEWVNRYLNFWGWTYFPVNFCFPSNLMPGAIVLDVILMLSNSMVLTAVIGGLAWGLLFYPGNWPIIAPLHVPVEYNGMMMTLADLQGYHYVRTGTPEYIRMVEKGTLRTFGKDVAP

SEQ ID NO: 452 - protein, 169 aa, unknown
  uncultured Methylobacter sp.
GDWDFWTDWKDRRLWVTVAPIVSITFPAAVQAVLWYRYRLPFGAVICILGLLLGEWVNRYLNFWGWTYFPVNFCFPSNLMPGAIVLDVILMLSNSMVLTAVIGGLAWGLLFYPGNWPIIAPLHVPVEYNGMMMTLADLQGYHYVRTGTPEYIRMVEKGTLRTFGKDVAP

SEQ ID NO: 453 - protein, 169 aa, unknown
  uncultured Methylobacter sp.
GDWDFWPDWKDRRLWVTVAPIVSITFPAAVQAILWYRYRLPFGAVICILGLLLGEWVNRYLNFWGWTYFPVNFCFPSNLMPGAIVLDVILMLSGSMTLTAVIGGLAWGLLFYPGNWPIIAPLHVPVEYNGMMMTLADLQGYHYVRTGTPEYIRMVEKGTLRTFGKDVAP

SEQ ID NO: 454 - protein, 169 aa, unknown
  uncultured Methylobacter sp.
GDWDFWTDWKDRRLWVTVAPIVSITFPAAVQAVLWYRYRLPFGAVISILGLLLGEWVNRYLNFWGWTYFPVNFCFPSNLMPGAIVLDAILMLSGSMTLTAVIGGLAWGLLFYPGNWPIIAPLHVPVEYNGMMMTLADLQGYHYVRTGTPEYIRMVEKGTLRTFGKDVAP

SEQ ID NO: 455 - protein, 169 aa, unknown
  uncultured Methylobacter sp.
GDWDFWTDWKDRRLWVTVAPIVSITFPAAVQAILWYRYRLPFGAVICILGLLLGEWVNRYLNFWGWTYFPVNFCFPSNLMPGAIVLDAILMLSGSMTLTAVLGGLAWGLLFYPGNWPIIAPLHVPVEYNGMMMALADLQGYHYVRTGTPEYIRMVEKGTLRTFGKDVAP

SEQ ID NO: 456 - protein, 169 aa, unknown
  uncultured Methylobacter sp.
GDWDFWTDWKDRRLWVTVAPIVSITFPAALQATLWWRYRLPFGAVVCILGLLLGEWVNRYLNFWGWTYFPVNFCFPSNLMPGAIVLDVILMLSGSMTVTAVIGGLAWGLLFYPGNWPIIAPLHVPVEYNGMMMTLADLQGYHYVRTGTPEYIRMVEKGTLRTFGKDVAP

SEQ ID NO: 457 - protein, 169 aa, unknown
  uncultured Methylobacter sp.
GDWDFWTDWKDRRLWVTVAPIVSITFPAAVQASLWWRYRLPFGAVVCVLGLLLGEWVNRYLNFWGWTYFPVNFCFPSNLMPGAIVLDAILMLTGSVTVTAVVGGLAWGLLFYPGNWPIIAPLHVPVEYNGMMMTLADLQGYHYVRTGTPEYIRMVEKGTLRTFGKDVAP

SEQ ID NO: 458 - protein, 169 aa, unknown
  uncultured Methylobacter sp.
GDWDFWTDWKDRRLWVTVAPIVSITFPAAVQACLWWRYRLPFGAVVCVLGLLLGEWINRYMNFWGWTYFPVNFCFPSNLMPGAIVLDVILMLTGSMTVTAVVGGLAWGLLFYPGNWPIIAPLHVPVEYNGMMMTLADLQGYHYVRTGTPEYIRMVEKGTLRTFGKDVAP

SEQ ID NO: 459 - protein, 169 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDAILMLSGSMTVTAVIGGLAWGLLFYPGNWPIIAPLHVPVEYNGMMMTLADLQGYHYVRTGTPEYIRMVEKGTLRTFGKDVAP

SEQ ID NO: 460 - protein, 169 aa, unknown
  uncultured Methylobacter sp.
GDWDFWTDWKGRRLWVTVAPIVSITFPAAVQAVLWWRYRLPFGAVVCVLGLLLGEWINRYLNFWGWTYFPVNFCFPSNLVPGAIVLDAILMLSGSMTVTAVIGGLAWGLLFYPGNWPIIAPLHVPVEYNGMMMTLADIQGYHYVRTGTPEYIRMVEKGTLRTFGKDVAP

SEQ ID NO: 461 - protein, 164 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDVILMLSGSMTVTAVIGGLAWGLLFYPGNWPIIAPLHVPVEYNGMMMTLADLQGYHYVRTGTPEYIRMVEKGTLRTFG

SEQ ID NO: 462 - protein, 169 aa, unknown
  uncultured Methylobacter sp.
GDWDFWTDWKDRRLWVTVAPIVSITFPAAVQAVLWWRYRLPFGAVVCVLGLLLGEWINRYLNFWGWTYFPVNFCFPSNLMPGAIVLDVILMLTGSMTVTAVIGGLAYGLLFYPGNWPIIALLHVPVEYNGMMMTLADLQGYHYVRTGTPEYIRMVEKGTLRTFGKDVAP

SEQ ID NO: 463 - protein, 169 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDAILMLSGSMTVTAVVGGLAWGLLFYPGNWPIIAPLHVPVEYNGMMMTLADLQGYHYVRTGTPEYIRMVEKGTLRTFGKDVAP

SEQ ID NO: 464 - protein, 169 aa, unknown; identical to SEQ ID NO: 459
  uncultured Methylobacter sp.

SEQ ID NO: 465 - protein, 169 aa, unknown
  uncultured Methylobacter sp.
GDWDFWTDWKDRRLWVTVAPIVSITFPAAVQAVLWWRYRIPFGAVLCILGLLLGEWVNRYLNFWGWTYFPVNFCFPSNLMPGAIVLDAILLLSGSMTVTAVIGGLAWGLLFYPGNWPIIAPLHVPVVYNGMMMTLADLQGYHYVRTGTPEYIRMVEKGTLRTFGKDVAP

SEQ ID NO: 466 - protein, 169 aa, unknown
  uncultured Methylobacter sp.
GDWDFWTDWKGRRLWVTVAPIVSITFPAAVQATLWWRYRLPFGAVVCILGLLLGEWVNRYLNFWGWTYFPVNFCFPSNLMPGAIVLDVILMLSGSMTVTAVVGGLTWGLLFYPGNWPIIAPLHVPVEYNGMMMTLADLQGYHYVRTGTPEYIRMVEKGTLRTFGKDVAP

SEQ ID NO: 467 - protein, 169 aa, unknown
  uncultured Methylobacter sp.
GDWDFWTDWKDRRLWVTVAPIVSITFPAAVQATLWWRYRLPFGAVVCILGLLLGEWVNRYLNFWGWTYFPVNFCFPSNLMPGTIVLDVILMLSGSMTVTAVVGGLAWGLLFYPGNWPIIAPLHVPVEYNGMMMTLADLQGYHYVRTGTPEYIRMVEKGTLRTFGKDVAP

SEQ ID NO: 468 - protein, 169 aa, unknown
  uncultured Methylobacter sp.
GDWDFWTDWKDRRLWVTVAPIVSITFPAAVQAVLWWRYRLPFGAVVCILGLLLGEWVNRYLNFWGWTYFPVNFCFPSNPMPGAIVLDVILMLSGSMTVTAVVGGLTWGLLFYPGNWPIIAPLHVPVEYNGMMMTLADLQGYHYVRTGTPEYIRMVEKGTLRTFGKDVAP

SEQ ID NO: 469 - protein, 169 aa, unknown
  uncultured Methylobacter sp.
GDWDFWTDWKDRRLWVTVAPIVSITFPAAVQACLWWRYRLPFGAVVCILGLLLGEWINRYLNFWGWTYFPVNFCFPSNLMPGAIVLDAILMLTGSMTVTAVIGGLAWGLLFYPGNWPIIAPLHVPVEYNGMMMTLADLQGYHYVRTGTPEYIRMVEKGTLRTFGKDVAP

SEQ ID NO: 470 - protein, 169 aa, unknown
  uncultured Methylobacter sp.
GDWDFWTDWKDRRLWVTVAPIVSITFPAAVQACLWWRYRLPFGAVVCILGLLLGEWINRYLNFWGWTYFPVNFCFPSNLMPGAIVLDAILMLSGSMTVTAVIGGLAWGLLFYPGNWPIIAPLHVPVEYNGMMMTLADLQGYHYVRTGTPEYIRMVEKGTLRTFGKDVAP

SEQ ID NO: 471 - protein, 169 aa, unknown
  uncultured Methylobacter sp.
GDWDFWTDWKDRPLWVTVAPIVSITFPAAVQAVLWWRYRLPFGALVCILGLLLGEWINRYLNFWGWTYFPVNFCLPSNLMPGAIVLDAILMLTGSMTVTAVIGGLAWGLLFYPGNWPIIAPLHVPVEYNGMMMTLADLQGYHYVRTGTPEYIKMVEKGTLTTFGKDVAP

SEQ ID NO: 472 - protein, 169 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDAILMLTGSMTVTAVIGGLAWGLLFYPGNWPIIAPLHVPVEYNGMMMTLADLQGYHYVRTGTPEYIRMVEKGKLRTFGKDVAP

SEQ ID NO: 473 - protein, 169 aa, unknown
  uncultured Methylobacter sp.
GDWDFWTDWKDRRLWVTVAPIVSITFPAAVQACLWYRYRLPFGAVVSVLALLLGEWINRYMNFWGWTYFPVNFCFPSNLIPGAIVLDVILMLSSSVTVTAVVGGLAWGLLFYPGNWPIIAPLHVPVEYNGMMMTLADLQGYHYVRTGTPEYIRMVEKGTLRTFGKDVAP

SEQ ID NO: 474 - protein, 169 aa, unknown
  uncultured Methylobacter sp.
GDWDFWTDWKDRRLWVTVAPIVSITFPAAVQAVLWWRYRLPFGAVVCILGLLLGEWINRYMNFWGWTYFPVNFCFPSNLMPGAIVLDVVLMMTNSMTITAVIGGMAWGLLFYPGNWPIMAPLHVPVEYNGMMMTLADLQGYHYVRTGTPEYIRMVEKGTLRTFGKDVAP

SEQ ID NO: 475 - protein, 169 aa, unknown
  uncultured Methylobacter sp.
GDWDFWTDWKDRRLWVTVAPIVSITFPAAVQACLWYRYRLPFGAVVCVLGLMLGEWVNRYLNFWGWTYFPVNFCFPSQLIPGAIVLDGIMLLGGSMTLTAVVGGLAWGLLFYPGNWPVIAPLHVPVEYNGMMMTLADLQGYNYVRTGTPEYIRMVEKGTLRTFGKDVAP

SEQ ID NO: 476 - protein, 169 aa, unknown
  uncultured Methylobacter sp.
GDWDFWTDWKDRRLWVTVAPIVSITFPAAVQACLWWRYRLPFGAVVCVLGLLLGEWVNRYLNFWGWTYFPVNFCFPSNLIPGAIVLDVVLMLSGSMTLTAVLGGMAWGLLFYPGNWPIIAPLHIPVEYNGMMFTLADLQGYHYVRTGTPEYIRMVEKGTLRTFGKDVAP

SEQ ID NO: 477 - protein, 169 aa, unknown
  uncultured Methylobacter sp.
GDWDFWTDWKDRRLWVTVAPIVSITFPAAVQATLWYRFRLPFGAVVSVLGLLLGEWVNRYMNFWGWTYFPVNFVFPSNLMPGAIVLDVILMLSNSMTLTAVVGGMAWGLLFYPGNWPIIAPLHIPVEYNGMMFTLADLQGYHYVRTGTPEYIRMVEKGATGTSGKDVAP

SEQ ID NO: 478 - protein, 169 aa, unknown
  uncultured Methylobacter sp.
GDWDFWTDWKDRRLWVTVAPIVSITFPAAVQATLWYRFRLPFGAVVSVLGLLLGEWVNRYMNFWGWTYFPVNFVFPSNLMPGAIVLDVILMLSNSMTLTAVVGGMAWGLLFYPGNWPIIAPLHIPVEYNGMMFTLADLQGYHYVRTGTPEYIRMVEKGTLRTFGKDVAP

SEQ ID NO: 479 - protein, 169 aa, unknown; identical to SEQ ID NO: 478
  uncultured Methylobacter sp.

SEQ ID NO: 480 - protein, 169 aa, unknown
  uncultured Methylobacter sp.
GDWDFWTDWKDRRLWVTVAPIVSITFPAAVQATLWYRFRLPFGAVVSVLGLLLGEWVNRYMNFWGWTYFPVNFVFPSNLMPGAIVLDVILMLSNSMTLTAVVGGMAWGLLFYPGNWPIIAPLHIPVEYNGMMSTLADLQGYHYVRTGTPEYIRMVEKGTLRTFGKDVAP

SEQ ID NO: 481 - protein, 169 aa, unknown
  uncultured Methylobacter sp.
GDWDFWTDWKDRRLWVTVAPIVSITFPAAVQATLWYRFRLPFGAVVSVLGLLLGEWVNRYMNFWGWTYFPVNFVFPSNLIPGAIVLDVILMLSNSMTLTAVVGGMAWGLLFYPGNWPIIAPLHIPVEYNGMMFTLADLQGYHYVRTGTPEYIRMVEKGTLRTFGKDVAP

SEQ ID NO: 482 - protein, 169 aa, unknown
  uncultured Methylobacter sp.
GDWDFWTDWKDRRLWVTVAPIVSITFPAAVQATLWYRFRLPFGGVVSVLGLLLGEWVNGYMNFWGWTYFPVNFVFPSNLMPGAIVLDVILMLSNSMTLTAVVGGMAWGLLFYPGNWPIIAPLHIPVEYNGMMFTLADLQGYHYVRTGTPEYIRMVEKGTLRTFGKDVAP

SEQ ID NO: 483 - protein, 169 aa, unknown
  uncultured Methylobacter sp.
GDWDFWTDWKDRRLWVTVAPIVSITFPAAVQATLWYRFRLPFGAVVSVLGLLLGVWVNRYMNFWGWTYFPVNFVFPSNLMPGAIVLDVILMLSNSMTLTAVVGGMARGLLFYPGNWPIIAPLHIPVEYNGMMFTLADLQGYHYVRTGTPEYIRMVEKGTLRTSGKDVAP

SEQ ID NO: 484 - protein, 169 aa, unknown
  uncultured Methylobacter sp.
GDWDFWTDWKDRRLWVTVAPIVSITFPAAVQATLWYRFRLPFGAVVSVLGLLLGEWVNRYMNFWGWTYFPVNFVFPSNLMPGAIVLDVILMLSNSMTLTAVVGGMAWGLLFYPGNWPIIAPLHVPVEYNGMLMSIADIQGYNYARTGTPEYIRMVEKGTLRTFGKDVAP

SEQ ID NO: 485 - protein, 169 aa, unknown
  uncultured Methylobacter sp.
GDWDFWTDWKDRRLWVTVAPIVSITFPAAVQAILWYRYRLPFGAVICILGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRTGTPEYIRMVEKGTLRTFGKDVAP

SEQ ID NO: 486 - protein, 169 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDAILMLTGSMTVTAVIGGLAWGLLFYPGNWPIIAPLHVPVEYNGMVMTLADLQGYHYVRTGTPEYIRMVEKGTLRTFGKDVAP

SEQ ID NO: 487 - protein, 169 aa, unknown
  uncultured Methylobacter sp.
GDWDFWTDWKDRRLWVTVAPIVSITFPAAVQAVLWWRYRLPFGAVVCILGLLLGEWINRYLNFWGWTYFPVNFCFPSNLMPGAIVLDAILMLTGSMTVTAVVGGLAWGLLFYPGNWPIIAPLHVPVEYNGMMMTLADLQGYHYVRTGTPEYIRMVEKGTLRTFGKDVAP

SEQ ID NO: 488 - protein, 169 aa, unknown
  uncultured Methylobacter sp.
GDWDFWTDWKDRRLWVTVAPIVSITFPAAVRACLWWRYRLPFGAVVCVLGLLLGEWINRYLNFWGWTYFPVNFCFPSNLMPGAIVLDAILMLTGSMTVTAVIGGLAWGLLFYPGNWPIIAPLHVPVEYNGMMMTLADLQGYHYVRTGTPEYIRMVEKGTLRTFGKDVAP

SEQ ID NO: 489 - protein, 169 aa, unknown
  uncultured Methylobacter sp.
GDWDFWTDWKDRRLWVTVAPIVSITFPAAVQACLWWRYRLPFGAVVCVLGLLLGEWVNRYLNFWGWTYFPVNFCFPSNLMPGAIVLDAILMLSGSMTLTAVLGGLAWGLLFYPGNWPIIAPLHVPVEYNGMMMTLADLQGYHYVRTGTPEYIRMVEKGTLRTFGKDVAP

SEQ ID NO: 490 - protein, 169 aa, unknown
  uncultured Methylobacter sp.
GDWDFWTDWKDRRLWVTVAPIVSITFPAAVQAVLWWRYRLPFGAVVCILGLLLGEWINRYMNFWGWTYFPVNFCFPSNLMPGAIVLDVVLMLTNSMTVTAVIGGMAWGLLFYPGNWPVMAPLHVPVEYNGMMMTLADLQGYHYVRTGTPEYIRMVEKGTLRTFGKDVAP

SEQ ID NO: 491 - protein, 169 aa, unknown
  uncultured Methylobacter sp.
GDWDFWTDWKDRRLWVTVAPIVSITFPAAVQACLWWRYRLPFGAVVCVLGLLLGEWINRYMNFWGWTYFPVNFVFPSQLIPGAIVLDVILMLSGSMTLTAVVGGLAYGLLFYPGNWPVIAPLHVPVEYNGMMMTLADLQGYHYVRTGTPEYIRMVEKGTLRTFGKDVAP

SEQ ID NO: 492 - protein, 169 aa, unknown
  uncultured Methylobacter sp.
GDWDFWTDWKDRRLWVTVAPIVSITFPAAVQACLWWRYRLPFGAVVCVLGLLLGEWINRYMNFWGWTYFPVNICFPSNLMPGAIVLDVILMLTGSMTVTAVIGGLAWGLLFYPGNWPIIAPLHVPVEYNGMMMTLADLQGYHYVRTGTPEYIRMVEKGTLRTFGKDVAP

SEQ ID NO: 493 - protein, 169 aa, unknown
  uncultured Methylobacter sp.
GDWDFWTDWKDRRLWVTVAPIVAITFPAAVQACLWWRYRLPFGAVVCVLGLLLGEWINRYMNFWGWTYFPVNFCFPSNLMPGAIVLDVILMLTNSMTVTAVIGGLSFGLLFYPGNWPIIAPLHVPVEYNGMMMTLADLQGYHYVRTGTPEYIRMVEKGTLRTFGKDVAP

SEQ ID NO: 494 - protein, 169 aa, unknown; identical to SEQ ID NO: 458
  uncultured Methylobacter sp.

SEQ ID NO: 495 - protein, 169 aa, unknown
  uncultured Methylobacter sp
GDWDFWSDWKDRRLWVTVAPIVSITFPAAVQACLWWRYRLPFGAVVCVLGLLLGEWVNRYMNFWGWTYFPVNICFPSNLMPGAIVLDVILMLSGSMTLTAVIGGLAYGLLFYPGNWPIIALLHVPVEYNGMMMTLADLQGYHYVRTGTPEYIRMVEKGTLRTFGKDVAP

SEQ ID NO: 496 - protein, 169 aa, unknown
  uncultured Methylobacter sp.
GDWDFWTDWKDRRLWVTVAPIVSITFPAAVQACLWWRYRLPFGAIVCVLGLLLGEWINRYLNFWGWTYFPVNFCFPSNLIPGAIVLDGILLLSGSMTLTAVLGGLSWGLLFYPGNWPIIAPLHVPVEYNGMMMTLADLQGYNYVRTGTPEYIRMVEKGTLRTFGKDVAP

SEQ ID NO: 497 - protein, 169 aa, unknown
  uncultured Methylobacter sp.
GDWDFWTDWKDRRLWVTVAPIVSITFPAAVQACLWWRYRLPFGAVVCVLGLLLGEWINRYLNFWGWTYFPVNFCFPSNLVPGAIVLDGILLLSGSMTLTAVLGGLAWGLLFYPGNWPIIAPLHVPVEYNGMMMTLADLQGYNYVRTGTPEYIRMVEKGTLRTFGKDVAP

SEQ ID NO: 498 - protein, 169 aa, unknown
  uncultured Methylobacter sp.
GDWDFWTDWKDRRLWVTVAPIVAITFPAAVQACLWYRYRLPFGAVVSVLGLLLGEWINRYLNFWGWTYFPVNFCFPSNLIPGAILLDVILMLSSSVTLTAVVGGLAWGLIFYPGNWPIIAPLHVPVEYNGMMMTLADLQGYHYVRTGTPEYIRMVEKGTLRTFGKDVAP

SEQ ID NO: 499 - protein, 169 aa, unknown
  uncultured Methylobacter sp.
GDWDFWTDWKDRRLWVTVAPIVSITFPAAVQACAWYRYRLPFGAVVCVLGLLLGEWINRYLNFWGWTYFPVNFCFPSNLIPGAIVLDGILLLGGSMTLTAVVGGLAWGLLFYPGNWPIIAPLHVPVEYNGMMMTLADLQGYNYVRTGTPEYIRMVEKGTLRTFGKDVAP

SEQ ID NO: 500 - protein, 169 aa, unknown
  uncultured Methylocaldum sp.
GDWDFWADWKDRRLWVTVTPIVLITFPAAIQAWAWEKFRNPWGATIAVLALLFGEWVNRYFNFWGWTYFPINFVFPALLVPGAILLDTFLMLSGSYLFTAIVGGLAWGLIFYPSNWPMIAPLHVPVEYNGMLMSIADIQGYHYVRTGTPEYIRMVEKGTLRTFGKDVAP

SEQ ID NO: 501 - protein, 169 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVFPAVLVPGAILLDTFLMLSGSYLFTAIVGGMAWGLVFYPGNWPIIAPLHVPVEYNGMLMSIADIQGYNYVRTGTPEYIRMVEKGTLRTFGKDVAP

SEQ ID NO: 502 - protein, 169 aa, unknown
  uncultured Methylocaldum sp.
GDWDFWSDWKDRRLWVTVTPIVLVTFPAAIQAWAWEKFRNPWGATIAVLALLFGEWVNRYFNFWGWTYFPINFVFPAILVPGAILLDTFLLLSGSYLFTAIVGGMAWGLIFYPGNWPMIAPLHVPVEYNGMLMSVADIQGYNYVRTGTPEYIRMVEKGTLRTFGKDVAP

SEQ ID NO: 503 - protein, 169 aa, unknown
  uncultured Methylocaldum sp.
GDWDFWSDWKDRRLWVTVTPIVLVTFPAAIQAWAWERFRNPWGATIAVLALLFGEWVNRYFNFWGWTYFPINFVFPAVLVPGAILLDTFLMLSGSYLFTAIVGGMAWGLVFYPGNWPVIAPLHVPVEYNGMLMSIADIQGYDYVRTGTPEYIRMVEKGTLRTFGKDVAP

SEQ ID NO: 504 - protein, 169 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVFPAVLVPGAILLDTFLMLSGSYLFTAIVGGMAWGLVFYPGNWPVIAPLHVPVEYNGMLMSIADIQGYNYVRTGTPEYIRMVEKGTLRTFGKDVAP

SEQ ID NO: 505 - protein, 169 aa, unknown
  uncultured Methylocaldum sp.
  VARIANT (1)...(169): Xaa = Any Amino Acid
GDWDFWSDWKDRRLWVTVTPIVLVTFPAAIQAWAWERFRNPWGATMAVLALLFGEWVNRYFNFWGWTYFPINFVFPAILVPGAIXLDTFLMLSGSYLFTAIVGGMAWGLIFYPGNWPMIAPLHVPVEYNGMLMSIADLQGYHYVRTGTPEYIRMVEKGTLRTFGKDVGP

SEQ ID NO: 506 - protein, 169 aa, unknown
  uncultured Methylocaldum sp.
GDWDFWSDWKDRRLWVTVTPIVLVTFPAAIQAWAWEKFRNPWGATIAVLALLFGEWVNRYFNFWGWTYFPINFVFPAVLVPGAILLDTFLMLSGSYLFTAIVGGMAWGLVFYPGNWPVIAPLHVPVEYNGMLMSIADIQGYNYVRTGTPEYIRMVEKGTLRTFGKDVAP

SEQ ID NO: 507 - protein, 169 aa, unknown
  uncultured Methylocaldum sp.
GDWDFWSDWKDRRLWVTVTPIVLVTFPAAIQAWAWEKFRNPWGATIAVLALLFGEWVNRYFNFWGWTYFPINFVFPAVLVPGAILLDTFLMLSGSYLFTAIVGGMAWGLVFYPGNWPMIAPLHVPVEYNGMLMSIADIQGYNYVRTGTPEYIRMVEKGTLRTFGKDVAP

SEQ ID NO: 508 - protein, 169 aa, unknown
  uncultured Methylocaldum sp.
GDWDFWADWKDRRLWVTVTPIVLITFPAAIQAWAWEKFRNPWGATIAVLALLFGEWVNRYFNFWGWTYFPINFVFPALLVPGAILLDTFLMLSGSYLFTAIVGGLAWGLVFYPGNWPVIAPLHVPVEYNGMLMSIADIQGYNYVRTGTPEYIRMVEKGTLRTFGKDVAP

SEQ ID NO: 509 - protein, 169 aa, unknown
  uncultured Methylocaldum sp.
GDWDFWADWKDRRLWVTVTPIVLITFPAAIQAWAWEKFRNPWGATIAVLALLFGEWVNRYFNFWGWTYFPINFVFPALLVPGAILLDTFLMLSGSYLFTAIVGGLAWGLIFYPSNWPMIAPLHVPVEYNGMLMSIADIQGYNYVRTGTPEYIRMVEKGTLRTFGKDVAP

SEQ ID NO: 510 - protein, 169 aa, unknown; identical to SEQ ID NO: 504
  uncultured Methylocaldum sp.

SEQ ID NO: 511 - protein, 169 aa, unknown
  uncultured Methylocaldum sp.
GDWDFWSDWKDRRLWVTVTPIVLVTFPAAIQAWAWEKFRNPWGATIAVLALLFGEWVNRYFNFWGWTYFPINLVFPAILVPGAILLDTFLMLSGSYLFTAIVGGMAWGLIFYPGNWPMIAPLHVPVEYNGMLMSIADIQGYNYVRTGTPEYIRMVEKGTLRTFGKDVAP

SEQ ID NO: 512 - protein, 169 aa, unknown
  uncultured Methylocaldum sp.
GDWDFWSDWKDRRLWVTVTLIVLVTFPAAIQAWAWERFRNPWGATIAVLALLFGEWVNRYFNFWGWTYFPINFVFPAVLVPGAILLDTFLMLSGSYLFTAIVGGLAWGLIFYPSNWPMIAPLHVPVEYNGMLMSIADIQGYHYVRTGTPEYIRMVEKGTLRTFGKDVAP

SEQ ID NO: 513 - protein, 149 aa, unknown
  uncultured Methylocaldum sp.
SDWKDRRLWVTVTPIVLVTFPAAIQAWAWERFRNPWGATIAVLALLFGEWVNRYFNFWGWTYFPINFVFPAVLVPGAILLDTFLMLSGSYLFTAIVGGMAWGLVFYPGNWPIIAPLHVPVEYNGMLMSIADIQGYNYVRTGTPEYIRRG

SEQ ID NO: 514 - protein, 148 aa, unknown
  uncultured Methylocaldum sp.
SDWKDRRLWVTVTPIVLVTFPAAIQAWTWERFRNPWGATMAVLALLFGEWVNRYFNFWGWTYFPINFVFPAILVPGAILLDTFLMLSGSYLFTAIVGGMAWGLIFYPGNWPMIAPLHVPVEYNGMLMSIADLQGYHYVRTGTPRVHPA

SEQ ID NO: 515 - protein, 169 aa, unknown
  uncultured Methylocaldum sp.
GDWDFWADWKDRRLWVTVTSIVLITFPAAIQAWAWEKFRNPWGATIAVLALLFGEWVNRYFNFWGWTYFPINFVFPALLVPGAILLDTFLMLSGSYLFTAIVGGLAWGLIFYPSNWPMIAPLHVPVEYNGMLMSIADIQGYHYVRTGTPEYIRMVEKGTLRTFGKDVAP

SEQ ID NO: 516 - protein, 169 aa, unknown; identical to SEQ ID NO: 500
  uncultured Methylocaldum sp.

SEQ ID NO: 517 - protein, 169 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVLPAVLVPGAILLDTFLMLSGSYLFTAIVGGMAWGLVFYPGNWPIIAPLHVPVEYNGMLMSIADIQGYNYVRTGTPEYIRMVEKGTLRTFGKDVAP

SEQ ID NO: 518 - protein, 159 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVFPAVLVPGAILLDTFLMLSGSYLFTAIVGGMAWGLVFYPGNWPIIAPLHVPVEYNGMLMSIADIQGYNYVRTGTPEYIRMVEKGT

SEQ ID NO: 519 - protein, 169 aa, unknown; identical to SEQ ID NO: 501
  uncultured Methylocaldum sp.

SEQ ID NO: 520 - protein, 169 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVFPVVLVPGAILLDTFLMLSGSYLFTAIVGGMAWGLVFYPGNWPIIAPLHVPVEYNGMLMSIADIQGYNYVRTGTPEYIRMVEKGTLRTFGKDVAP

SEQ ID NO: 521 - protein, 169 aa, unknown; identical to SEQ ID NO: 501
  uncultured Methylocaldum sp.

SEQ ID NO: 522 - protein, 152 aa, unknown
  uncultured Methylocaldum sp.
VTPIVLVTFPAAIQAWAWERFRNPWGATVAVLALLFGEWVNRYFNFWGWTYFPINFVFPAVLVPGAILLDTFLMLSGSYLFTAIVGGMAWGLVFYPGNWPIIAPLHVPVEYNGMLMSIADIQGYNYVRTGTPEYIRMVEKGTLRTFGKDVAP

SEQ ID NO: 523 - protein, 169 aa, unknown
  uncultured Methylocaldum sp.
GDWDFWSDWKDRRLWVTVTPIVLVTFPAAIQAWAWERFRNPWGATVAVLALLFGEWVNRYFNFWGWTYFPINFVFPAVLVPGAILLDTFLMLSGSYLFTAIVGGMAWGLVFYPGNWPIIAPLHVPVEYNGMLMSIADIQGYNYARTGTPEYIRMVEKGTLRTFGKDVAP

SEQ ID NO: 524 - protein, 169 aa, unknown; identical to SEQ ID NO: 501
  uncultured Methylocaldum sp.

SEQ ID NO: 525 - protein, 89 aa, unknown
  uncultured Methylocaldum sp.
  VARIANT (1)...(89): Xaa = Any Amino Acid
AILLDTFLMLSGSYLFPAIVGGMAWGLVFYPGNWPMIAPLLVPVEYNGMLMSIANIXGYNYVRTGTPEYIRMVEKGTLRTFGKDVAPGR

SEQ ID NO: 526 - protein, 95 aa, unknown
  uncultured Methylococcaceae bacterium
YFPVNFCFPSNLMPGAIVLDVVLMLTNSMTITAVIGGMAYGLLFYPGNWPIMAPLHVPVEYNGMMMTLADLQGYHYVRTGTPEYIRMVEKGTLRT

SEQ ID NO: 527 - protein, 95 aa, unknown
  uncultured Methylococcaceae bacterium
YFPVNICFPSNLLPGAIVLDVILMMGNSMTLTAVVGGLAYGLLFYPGNWPVIAPLHVPVEYNGMMMTLADLQGYHYVRTGTPEYIRMVEKGTLRT

SEQ ID NO: 528 - protein, 95 aa, unknown
  uncultured Methylococcaceae bacterium
YFPVNICFPSNLLPGAIVLDVILMMGNSMTLTAVVGGLAYGLLFYPGNWPVIAPLHVPVEYNGMMMTLADLQGYHYVRTGTPEYIRMVGKGTLRT

SEQ ID NO: 529 - protein, 95 aa, unknown
  uncultured Methylococcaceae bacterium
YFPVNFCFPSTLMPGAIVLDVVLMLTNSMTITAVIGGMAYGLLFYPGNWPIMAPLHVPVEYNGMMMTLADLQGYHYVRTGTPEYIRMVEKGTLRT

SEQ ID NO: 530 - protein, 157 aa, unknown
  uncultured Methylococcaceae bacterium
TDWKDRRLWVTVAPIVSITFPAAVQACLWWRYRLPIGATLSVVALMIGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTF

SEQ ID NO: 531 - protein, 157 aa, unknown
  uncultured Methylococcaceae bacterium
TDWKDSRLWVTVAPIVSITFPAAVQAILWYRYRLPFGAVLCVLGLLLGEWVNRYLNFWGWTYFPVNFCFPSNLMPGAVVLDAILMLSGSMTLTAVVGGLAWGLLFYPGNWPIIAPLHVPVEYNGMMMTLADLQGYHYVRTGTPEYIRMVEKGTLRTF

SEQ ID NO: 532 - protein, 157 aa, unknown
  uncultured Methylococcaceae bacterium
TDWKDRRLWVTVAPIVSITFPAAVQATLWYRYRLPFGAVVCILGLLLGEWINRYLNFWGWTYFPVNFCFPSNLMPGAIVLDVILMLTGSMTVTAVIGGLAWGLLFYPGNWPIIAPLHVPVEYNGMMMTLADLQGYHYVRTGTPEYIRMVEKGTLRTF

SEQ ID NO: 533 - protein, 157 aa, unknown
  uncultured Methylococcaceae bacterium
SDWKDRRLWVTVLPIMAITFPAAVQASLWWRYRIAFGSTLCVLGLLFGEWVNRYFNFWGWTYFPINFVFPSQLIPGAIVLDVVLLVSNSMQLTAVVGGLGFGLLFYPGNWPMMAPLHLPVEYNGMMMTLADLSGYHYVRTGMPEYIRMVEKGTLRTF

SEQ ID NO: 534 - protein, 157 aa, unknown
  uncultured Methylococcaceae bacterium
TDWKDRRLWVTVLPIVGITFPAAVQSVLWYRYRLPFGAVLAVLGLLFGEWVNRYFNFWGWTYFPVNFVFPSQFVPGAIVLDVILMLSNSMQLTAVVGGLAYGLLFYPGNWPVIAPLHVPVEYNGMVMTLADLQGYHYVRTGTPEYIRMVEKGTLRTF

SEQ ID NO: 535 - protein, 168 aa, unknown
  uncultured Methylococcaceae bacterium
TPLIGITFPAAVQAVLWDKFRLPLGATLCVAALLLGTWVTRVFAYHYWNFFPINMVLPATMVPGALVLDTLLMLTNSLTITSIFGGGAFALLFYPTNWPIFGMFHQAVEYHNSQLTVADLFGFQYIRTGMPEYLRIIERGTLRTYGQYATPLAAFCSALLCSLMYPLW

SEQ ID NO: 536 - protein, 168 aa, unknown
  uncultured Methylococcaceae bacterium
TPLIGITFPAAVQAVLWDKFRLPLGATLCVAALLIGTWVARIFAYHYWNFFPVNMVLPATMVPGALVLDTLLMLTNSLTITSIFGGGAFALLFYPTNWPIFGMFHQAVEYHNSQLTVADLFGFQYIRTGMPEYLRIIERGTLRTYGQYATPLAAFCSALLCSLMYPLW

SEQ ID NO: 537 - protein, 168 aa, unknown
  uncultured Methylococcaceae bacterium
TPLIGITFPAAVQAVLWEKFRLPLGATLCVAALLIGTWVTRVFAYHCWNYFPINMVLPATMVPGALVLDTLLMLTNSLTITSIFGGAAFALLFYPTNWPIFGMFHQPVEYHNSQLTVADLFGFQYIRTGMPEYLRIIERGTLRTYGQYATPLAAFCSALLCSLMYPLW

SEQ ID NO: 538 - protein, 168 aa, unknown
  uncultured Methylococcaceae bacterium
TPLIGITFPAAVQAVLWDKFRLPLGATLCVAALLLGTWVTRVFAYHYWNYFPINMVLPATMVPGALVLDTLLMLTNSLTITSIFGGGAFALLFYPTNWPIFGMFHQPVEYANSQLTVADLFGFQYIRTGMPEYLRIIERGTLRTYGQYATPLAAFCSALLCSLMYPLW

SEQ ID NO: 539 - protein, 168 aa, unknown
  uncultured Methylococcaceae bacterium
TPLIGITFPAAVQAVLWDKFRLPLGATLCIAALLLGTWVTRVFAYHYWNLFPINMVLPATMIPGALVLDTLLMLANSLTITSIFGGAAFALLFYPTNWPIFGMFHQPVEVANSQLTAADLFGFQYIRTGMPEYLRIIERGTLRTYGQYATPLSAFCSALLCSLMYPLW

SEQ ID NO: 540 - protein, 168 aa, unknown
  uncultured Methylococcaceae bacterium
TPLMGITFPAAAQAVLWDKFRLPLGATLCVAALLIGTWITRIFAYHYWNFFPINMVLPATMLPGAMVLDAMLMLSNSLTITAIFGGAAFALLFYPSNWPIFAMFHQPVEYANSQLTVADLFGFQYIRTGMPEYLRIIERGTLRTYGQYAAPLAAFCSALLCSLMYVLW

SEQ ID NO: 541 - protein, 168 aa, unknown
  uncultured Methylococcaceae bacterium
TPLMGITFPAAVQSVMWTKFRLPMGASLCVSALLIGTWVTRIFAYHYWNFFPINMVLPATMLPGALVLDAILMLSNSLTVTAIFGGAAFALLFYPSNWPIFGMFHIPIEYGNTQMTVADMFGFQYIRTGMPEYLRIIERGTLRTYGQYAAPLAAFCSALLCTLMYTLW

SEQ ID NO: 542 - protein, 168 aa, unknown
  uncultured Methylococcaceae bacterium
TPLIGITFPAAVQAVLWEKFRLPLGATLCVAALLIGTWVTRVFAYHYWNYFPINMVLPATMVPGALVLDTLLMLTNSLTITSIFGGAAFALLFYPTNWPIFGMFHQPVEYHNSQLTVADLFGFQYIRTGMPEYLRIIERGTLRTYGQYATPLAAFCSALLCSLMYPLW

SEQ ID NO: 543 - protein, 168 aa, unknown
  uncultured Methylococcaceae bacterium
TPLIGITFPAAVQAVLWDKFRLPLGATLCVAALLIGTWVARIFAYHYWNFFPVNMVLPATMVPGALVLDTLLMLTNSLTITSIFGGGAFALLFYPTNWPVFGMFHQAVEYHNSQLTVADLFGFQYIRTGMPEYLRIIERGTLRTYGQYATPLAAFCSALLCSLMYPLW

SEQ ID NO: 544 - protein, 169 aa, unknown
  uncultured Methylococcus sp.
GDWDFWSDWKDRRLWVTVTPIVLITFPAAVQYFLWERFRQPWGATVCVLALLFGEWINRYFNFWGWTYFPVNFCFPAIQVPGAILLDVALLLSGSYLFTAIIGAMAWGLIFYPGNWPIIAPLHVPVEYNGTLMSIADIQGYNYVRTGTPEYIRMVEKGTLRTFGKDVAP

SEQ ID NO: 545 - protein, 169 aa, unknown
  uncultured Methylococcus sp.
GDWDFWSDWKDRRLWVTVTPIVLITFPAAVQYFLWERFRQPWGATLCVLALLFGEWVNRYFNFWGWTYFPVDFVFPSVLVPGAILLDTVLMLSGSYLFAAIIGGMAWGLIFYPGNWPVIAPLHVPVEYNGMLMSVADIQGYNYVRTGTPEYIRMVEKGTLRTFGKDVAP

SEQ ID NO: 546 - protein, 169 aa, unknown
  uncultured Methylococcus sp.
GDWDFWADWKDRRLWVTVTPIVLITFPAAVQSYLWERYRQPWGATVCVLGLLLGEWINRYFNFWGWTYFPVNFVFPAILTPGAIILDTMLMLSGSYLFTAVVGAMGWGLIFYPGNWPIIAPIHVPVEYSGMLMSIADIQGYNYVRTGTPEYIRMVEKGTLRTFGKDVAP

SEQ ID NO: 547 - protein, 169 aa, unknown
  uncultured Methylococcus sp.
GDWDFWVDWKDRRLWVTVVPIVLITFPAAIQAWLWERFRLPWGATLCVIALLFGEWINRYFNFWGWTYFPINLVFPSQIVPGAILLDTVLLLSGSYLFTAIVGAMGWGLIFYPGNWPVIAPFHVPVEYNGTLMSVADILGYNYVRTGTPEYIRMVEKGTLRTFGKDVAP

SEQ ID NO: 548 - protein, 169 aa, unknown
  uncultured Methylococcus sp.
GDWDFWSDWKDRRLWVTVTPIVLITFPAAVQSYLWERYRQPWGATVCVLGLLLGEWINRYFNFWGWTYFPVNFVFPAILTPGAILLDTMLMLSGSYLFTAVVGAMGWGLIFYPGNWPIIAPIHVPVEYSGMLMSIADIQGYNYVRTGTPEYIRMVEKGTLRTFGKDVAP

SEQ ID NO: 549 - protein, 169 aa, unknown
  uncultured Methylococcus sp.
GDWDFWSDWKDRRLWVTVTPIVLITFPAAVQSYLWERYRQPWGATVCVLGLLLGEWINRYFNFWGWTYFPVNFVFPAILTPGAILLDTVLLLSGSYLFTAIIGAMGWGLIFYPGNWPIIAPLHVPVEYSGMLMSIADIQGYNYVRTGTPEYIRMVEKGTLRTFGKDVAP

SEQ ID NO: 550 - protein, 169 aa, unknown
  uncultured Methylococcus sp.
GDWDFWSDWKDRRLWVTVTPIVLVTFPAAVQSYLWERYRLPWGATVCVLGLLLGEWINRYFNFWGWTYFPVNFVFPSSLVPGAIILDTVLMLSGSYLFTAIVGAMGWGLIFYPGNWPIIAPLHVPVEYNGMLMSIADIQGYNYVRTGTPEYIRMVEKGTLRTFGKDVAP

SEQ ID NO: 551 - protein, 169 aa, unknown
  uncultured Methylococcus sp.
GDWDFWSDWKDRRLWVTVTPIVLVTFPAAVQYFLWERFRQPWGATVCVLALLFGEWVNRYFNFWGWTYFPVNFVFPAILVPGAILLDTVLLLSGSYLFTAIIGAMAWGLIFYPGNWPIIAPLHVPVEYNGMLMSIADIQGYNYVRTGTPEYIRMVEKGTLRTFGKDVAP

SEQ ID NO: 552 - protein, 169 aa, unknown
  uncultured Methylococcus sp.
GDWDFWADWKDRRLWVTVTPIVLITFPAAVQYFLWERFRQPWGATLCVLALLFGEWVNRYLNFWGWTYFPVNFVFPAILVPGAILLDTFLMLSGSYLFTAIVGGMAWGLIFYPGNWPIIAPLHVPVEYNGMLMSIADIQGYNYVRTDTPEYIRMVEKGTLRTFGKDVAP

SEQ ID NO: 553 - protein, 169 aa, unknown
  uncultured Methylococcus sp.
GDWDFWADWKDRRLWVTVTPIVLITFPAAVQYFLWERFRQPWGATLCVLALLFGEWVNRYFNFWGWTYFPVNFVFPAILVPGAILLDTFLMLSGSYLFTAIVGGMAWGLIFYPGNWPIIAPLHVPVEYNGMLMSIADIQGYNYVRTGTPEYIRMVEKGTLRTFGKDVAP

SEQ ID NO: 554 - protein, 169 aa, unknown
  uncultured Methylomicrobium sp.
GDWDFWTDWKDRRLWVTVLPIVGITFPAAVQAVLWYRWKLPFGAMLAVLGLLFGEWVNRYFNFWGWTYFPVNFVFPSQFVPGALVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 555 - protein, 169 aa, unknown; identical to SEQ ID NO: 512
  uncultured Methylomicrobium sp.

SEQ ID NO: 556 - protein, 168 aa, unknown
  uncultured Methylomicrobium sp.
GDWDFWTDWKDRRLWVTVLPVVGITFPAAVQAVLWYRWKLPFGAMLAVLGLLFGEWVNRYFNFWGWTYFPVNFVFPSQFVPGALVLVVILMLSNSMQLTAVLGGLAYGLLFYPGNWPVIAPLHVPVEYNGMVMTLADLQGYHYVRTGTPEYIRMVEKGTLRTFGKDVA

SEQ ID NO: 557 - protein, 169 aa, unknown; identical to SEQ ID NO: 512
  uncultured Methylomicrobium sp.

SEQ ID NO: 558 - protein, 168 aa, unknown
  uncultured Methylomicrobium sp.
DWDFWTDWKDRRLWVTVLPIVGITFPAAVQAVLWYRWKLPFGAMLAVLGLLFGEWVNRYFNFWGWTYFPVNFVFPSQFVPGALVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 559 - protein, 165 aa, unknown
  uncultured Methylomicrobium sp.
FWTDWKDRRLWVTVLPIVGITFPAAVQAVVWYRWKLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 560 - protein, 169 aa, unknown
  uncultured Methylomicrobium sp.
GDWDFWTDWKDRRLWVTVAPIVSITFPAAVQAVLWWRYRTAWGATLCILGLLLGEWINRYFNFWGWTYFPVNFVFPSNLMPGAIVLDVILMLSNSMTLTAVVGGLAWGLLFYPGNWPIIAPLHVPVEYNGMMMTLADLQGYHYVRTGTPEYIRMVEKGTLRTFGKDVAP

SEQ ID NO: 561 - protein, 169 aa, unknown
  uncultured Methylomicrobium sp.
GDWDFWTDWKDRRLWVTVLPIVGITFPAAVQSVLWYRYRLPFGAVLAVLGLLFGEWVNRYFNFWGWTYFPVNFVFPSQFVPGAIVLDVILMLGNSMQLTAVVGGLAYGLLFYPGNWPVIAPLHVPVEYNGMVMTLADLQGYHYVRTGTPEYIRMVEKGTLRTFGKDVAP

SEQ ID NO: 562 - protein, 164 aa, unknown
  uncultured Methylomicrobium sp.
GDWDFWTDWKDRRLWVTVLPIVGITFPAAVQAVLWYRWKLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLRTFG

SEQ ID NO: 563 - protein, 109 aa, unknown
  uncultured Methylomonas sp.
GNFWGWTYFPVNICFPSNLLPGAIVLDVILMMGNSMTLTAVVGGLAYGLLFYPGNWPVIAPLHVPVEYNGMMMTLADLQGYHYVRTRTPEYIRMVEKGTLRTFRNDVPP

SEQ ID NO: 564 - protein, 109 aa, unknown; identical to SEQ ID NO: 422
  uncultured Methylomonas sp.

SEQ ID NO: 565 - protein, 109 aa, UNKNOWN; identical to SEQ ID NO: 421
  uncultured Methylomonas sp.

SEQ ID NO: 566 - protein, 109 aa, unknown
  uncultured Methylomonas sp.
GNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMVEKGTLRTFGNDVVP

SEQ ID NO: 567 - protein, 169 aa, unknown
  uncultured Methylomonas sp.
GDWDFWTDWKDRRLWVTVAPIVSITFPAAVQACLWWRYRLPIGATVSVVALMLGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGSLRTFGKDVAP

SEQ ID NO: 568 - protein, 169 aa, unknown
  uncultured Methylomonas sp.
GDWDFWTDWKDRRLWVTVAPIVSITFPAAVQACLWWRYRLPIGATVSVVALMLGEWINRYMNFWGWTYFPVNICFPSNLLPGAIVLDVILMLGNSMTLTAVVGGLAYGLLFYPGNWPIIAPLHVPVEYNGMMMTLADLQGYHYVRTGTPEYIRMVEKGTLRTFGKDVAP

SEQ ID NO: 569 - protein, 169 aa, unknown
  uncultured Methylomonas sp.
GDWDFWTDWKDRRLWVTVAPIVSITFPAAVQACLWWRYRLPIGATVSVVALMLGEWINRYMNFWGWTYFPVNICFPSNLLPGAIVLDVILMLGNSMTLTAVIGGLAYGLLFYPGNWPIIAPLHVPVEYNGMMMTLADLQGYHYVRTGTPEYIRMVEKGTLRTFGKDVAP

SEQ ID NO: 570 - protein, 169 aa, unknown
  uncultured Methylomonas sp.
GDWDFWTDWKDRRLWVTVAPIVSITFPAAVQACLWWRYRLPIGATVSVVALMVGEWINRYMNFWGWTYFPVNICFPSNLLPGAIVLDVILMLGNSMTLTAVVGGLAYGLLFYPGNWPIIAPLHVPVEYNGMMMTLADLQGYHYVRTGTPEYIRMVEKGTLRTFGKDVAP

SEQ ID NO: 571 - protein, 169 aa, unknown
  uncultured Methylomonas sp.
GDWDFWTDWKDRRLWVTVAPIVSITFPAAVQACLWWRYRLPIGATVSVVALMLGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGTLRTFGKDVAP

SEQ ID NO: 572 - protein, 169 aa, unknown
  uncultured Methylomonas sp.
GDWDFWTDWKDRRLWVTVAPIVSITFPAAVQACLWWRYRLPIGATISVVALMLGEWINRYMNFWGWTYFPVNICFPSNLLPGAIVLDVILMLGNSMTLTAVIGGLAYGLLFYPGNWPIIAPLHVPVEYNGMMMTLADLQGYHYVRTGTPEYIRMVEKGTLRTFGKDVAP

SEQ ID NO: 573 - protein, 169 aa, unknown; identical to SEQ ID NO: 569
  uncultured Methylomonas sp.

SEQ ID NO: 574 - protein, 169 aa, unknown; identical to SEQ ID NO: 572
  uncultured Methylomonas sp.

SEQ ID NO: 575 - protein, 169 aa, unknown
  uncultured Methylomonas sp.
GDWDFWTDWKDRRLWVTVAPIVSITFPAAVQACLWWRYRLPIGATISVVALMVGEWINRYMNFWGWTYFPVNICFPSSLLPGAIVLDVILVLGNSMTLTAVVGGLAYGLLFYPGNWPIIAPLHVPVEYNGMMMTLADLQGYHYVRTGTPEYIRMVEKGTLRTFGKDVAP

SEQ ID NO: 576 - protein, 169 aa, unknown; identical to SEQ ID NO: 568
  uncultured Methylomonas sp.

SEQ ID NO: 577 - protein, 169 aa, unknown; identical to SEQ ID NO: 568
  uncultured Methylomonas sp.

SEQ ID NO: 578 - protein, 169 aa, unknown; identical to SEQ ID NO: 568
  uncultured Methylomonas sp.

SEQ ID NO: 579 - protein, 169 aa, unknown
  uncultured Methylomonas sp.
GDWDFWTDWKDRRLWVTVAPIVSITFPAAVQACLWWRYRLPIGATISVVALMLGEWINRYMNFWGWTYFPVNICFPSNLLPGAIVLDVILMLGNSMTLTAVIGGLAYGLLFYPGNWPIIAPLHVPVEYNGMIMTLADLQGYHYVRTGTPEYIRMVEKGTLRTFGKDVAP

SEQ ID NO: 580 - protein, 169 aa, unknown; identical to SEQ ID NO: 572
  uncultured Methylomonas sp.

SEQ ID NO: 581 - protein, 169 aa, unknown; identical to SEQ ID NO: 569
  uncultured Methylomonas sp.

SEQ ID NO: 582 - protein, 169 aa, unknown; identical to SEQ ID NO: 569
  uncultured Methylomonas sp.

SEQ ID NO: 583 - protein, 169 aa, unknown
  uncultured Methylomonas sp.
GDWDFWTDWKDRRLWVTVAPIVSITFPAAVQACLWWRYRLPLGATLSVLALMLGEWINRYMNFWGWTYFPVNICFPSNLIPGAIVLDVVLMLGNSMTLTAVVGGLAYGLLFYPGNWPIIAPLHVPVEYNGMMMTLADLQGYHYVRTGTPEYIRMVEKGTLRTFGKDVAP

SEQ ID NO: 584 - protein, 169 aa, unknown
  uncultured Methylomonas sp.
GDWDFWTDWKGRRLWVTVAPIVSITFPAAVQACLWWRYRLPVGATLSVVALMIGEWINRYMNFWGWTYFPVSICFPSNLIPGAIVLDTILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 585 - protein, 168 aa, unknown
  uncultured Methylomona sp.
GLGLRTDWKDRRLWVTVAPIVSITFPAAVQACLWWRYRLPIGATISVVALMVGEWINRYMNFWGWTYFPVNICFPFNLLPGAIVLDVVLMLGNSMTLTAVIGGLAYGLLFYPGNWPVIAPLHVPVEYNGMMMTLADLQGYHYVRTGTPEYIRMVEKGTLRTFGKDVAP

SEQ ID NO: 586 - protein, 162 aa, unknown
  uncultured Methylomonas sp.
TGKIDVYGVTVAPIVSITFPAAVQACLWWRYRLPIGATISVVALMIGEWINRYMNFWGWTYFPVNICFPSNLLPGAIVLDVILMLGNSMTLTAVLGGLAYGLLFYPGNWPVIAPLYVPVEYNGMMMTLADLQGYHYVRTGTPEYIRMVEKGTLRTFGKDVAP

SEQ ID NO: 587 - protein, 169 aa, unknown
  uncultured Methylomonas sp.
GDWDFWTDWKDRRLWVTVAPIVSITFPAAVQACLWWRYRLPIGATISVVALMIGEWINRYMNFWGWTYFTVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAP

SEQ ID NO: 588 - protein, 169 aa, unknown
  uncultured Methylomonas sp.
GDWDFWTDWKDRRLWVTVAPIVSITFPAAVQACLRWRYRLPIGATISVVALMIGEWINRYMNFWGWTYFPVNICFPSNLLPGAIVLDVILMLGNSMTLTAVLGGLAYGLLFYPGNWPVIAPLHVPVEYNGTMMTLADLQGYHYVRTGTPEYIRMVEKGTLRTFGKDVAP

SEQ ID NO: 589 - protein, 169 aa, unknown
  uncultured Methylomonas sp.
GDWDFWTDWKDRRLWVTVAPIVSITFPAAVQACLWWRYRLPIGATISVVALMIGEWINRYMNFWGWTYFPVNICFPSNLLPGAIVLDVILMLGNSMTLTAILGGLAYGLLFYPGNWPVIAPLHVPVEYNGMMMTLADLQGYHYVRTGTPEYIRMVEKGTLRTFGKDVAP

SEQ ID NO: 590 - protein, 169 aa, unknown
  uncultured Methylomonas sp.
GDWDFWTDWKDRRLWVTVAPIVSITFPAAVQACLWWRYRLPIGATISVVALMIGEWINRYMNFWGWTYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAP

SEQ ID NO: 591 - protein, 169 aa, unknown
  uncultured Methylomonas sp.
GDWDFWTDWKDRRLWVTVAPIVSITFPAAVQACLWWRYRLPVGATLSVVALMIGEWINRYMNFWGWTYFPVNICFPSNLIPGAIVLDTILMLGNSITLTAVVGGLAYGLLFYPGNWPVIAPLHVPVEYNGMMMTLADLQGYHYVRTGTPEYIRMVEKGTLRTFGKDVAP

SEQ ID NO: 592 - protein, 169 aa, unknown; identical to SEQ ID NO: 163
  uncultured Methylomonas sp.

SEQ ID NO: 593 - protein, 169 aa, unknown
  uncultured Methylomonas sp.
GDWDFWTDWKDRRLWVTVAPIVSITFPAAVQACLWWRYRLPIGATISVVALMVGEWINRYMNFWGWTYFPVNICFPSNLLPGAIVLDVVLMLGNSMTLTAVIGGLAYGLLFYPGNWPVIAPLHVPVEYNGMMMTLADLQGYHYVRTGTPEYIRMVEKGTLRTFGKDVAP

SEQ ID NO: 594 - protein, 169 aa, unknown
  uncultured Methylomonas sp.
GDWDFWTDWKDRRLWVAVAPIVSITFPAAVQACLWWRYRLPVGATLSVVALMIGEWINRYMNFWGWTYFPVNICFPSNLIPGAIVLDTILMLGNSMTLTAVVGGLAYGLLFYPGNWPVIAPLHVPVEYNGMMMTLADLQGYHYVRTGTPEYIRMVEKGTLRTFGKDVAP

SEQ ID NO: 595 - protein, 169 aa, unknown; identical to SEQ ID NO: 168
  uncultured Methylomonas sp.

SEQ ID NO: 596 - protein, 169 aa, unknown; identical to SEQ ID NO: 168
  uncultured Methylomonas sp.

SEQ ID NO: 597 - protein, 169 aa, unknown; identical to SEQ ID NO: 168
  uncultured Methylomonas sp.

SEQ ID NO: 598 - protein, 169 aa, unknown
  uncultured Methylomonas sp.
GDWDFWTDWKDRRLWVAVAPIVSITFPAAVQACLWWRYRLPIGATISVVALMIGEWINRYMNFWGWSYFPVNICFPSNLLPGAIVLDVILMLGNSMTLTAVLGGLAYGLLFYPGNWPVIAPLHVPVEYNGMMMTLADLQGYHYVRTGTPEYIRMVEKGTLRTFGKDVAP

SEQ ID NO: 599 - protein, 169 aa, unknown
  uncultured Methylosarcina sp.
GDWDFWTDWKDRRLWVTVLPIVGITFPAAVQAVLWWRYRLPFGAVLSVLGLLFGEWVNRYFNFWGWTYFPVNFVFPSNFMPGAIVLDVILMLSNSMQLTAVLGGLGYGLLFYPGNWPVIAPLHVPVEYNGMVMTLADLQGYHYVRTGTPEYIRMVEKGTLRTFGKDVAP

SEQ ID NO: 600 - protein, 169 aa, unknown
  uncultured Methylosarcina sp.
GDWDFWTDWKDRRLWVTVLPIVGITFPAAAQSVLWYRWKLPFGAMLAVLGLLFGEWVNRYFNFWGWTYFPVNFVFPSQFVPGAIVLDVILMLSNSMQLTAVLGGLAYGLLFYPGNWPVIAPLHVPVEYNGMVMTLADLQGYHYVRTGTPEYIRMVEKGTLKNFGKDVAP

SEQ ID NO: 601 - protein, 169 aa, unknown
  uncultured Methylosarcina sp.
GDWDFWTDWKDRRLWVTVLPIVGITFPAAVQAVLWYRYRLPFGAMLAVLGLLFGEWVNRYFNFWGWTYFPVNFVFPSQFVPGALVLDVILMLGNSMQLTAVIGGLAYGLLFYPGNWPVIAPLHVPVEYNGMVMTLADLQGYHYVRTGTPEYIRMVEKGTLRTFGKDVAP

SEQ ID NO: 602 - protein, 169 aa, unknown
  uncultured Methylosarcina sp.
GDWDFWVDWKDRRLWVTVLPIVGITFPAAVQAVLWWRYRLPFGAVLSVLGLLFGEWVNRYFNFWGWTYFPVNFAFPSNFMPGAIVLDVILMLSNSMQLTAVIGGLGYGLLFYPGNWPVIAPLHVPVEYNGMVMTLADLQGYHYVRTGTPEYIRMVEKGTLRTFGKDVAP

SEQ ID NO: 603 - protein, 169 aa, unknown; identical to SEQ ID NO: 601
  uncultured Methylosarcina sp.

SEQ ID NO: 604 - protein, 169 aa, unknown
  uncultured Methylosarcina sp.
GDWDFWTDWKDRRLWVTVCPIVGITFPAAVQSVLWYRYKLPFGAVLSVLGLLLGEWVNRYFNFWGWTYFPVNFVFPSQFVPGAIVLDVILMLSNSMQLTAVIGGLAYGLLFYPGNWPVIAPLHVPVEYNGMVMTLADLQGYHYVRTGTPEYIRMVEKGTLRTFGKDVAP

SEQ ID NO: 605 - protein, 169 aa, unknown
  uncultured Methylosarcina sp.
GDWDFWTDWEDRRLWVTVLPIVGITFPAAVQAVLWYRYRLPFGAMLAVLGLLFGEWVNRYFNFWGWTYFPVNFVFPSQFVPGALVLDVILMLGNSMQLTAVIGGLAYGLLFYPGNWPVIAPLHVPVEYNGMVMTLADLQGYHYVRTGTPEYIRMVEKGTLRTFGKDVAP

SEQ ID NO: 606 - protein, 169 aa, unknown; identical to SEQ ID NO: 601
  uncultured Methylosarcina sp.

SEQ ID NO: 607 - protein, 169 aa, unknown; identical to SEQ ID NO: 601
  uncultured Methylosarcina sp.

SEQ ID NO: 608 - protein, 169 aa, unknown
  uncultured Methylosarcina sp.
GDWDFWTDWKDRRLWVTVLPIVGITFPAAVQAVLWYRYRLPFGAMLAVLGLLFGEWVNRYFNFWGWTYFPVNFVFPSRFVPGALVLDVILMLGNSMQLTAVIGGLAYGLLFYPGNWPVIAPLHVPVEYNGMVMTLADLQGYHYVRTGTPEYIRMVEKGTLRTFGKDVAP

SEQ ID NO: 609 - protein, 169 aa, unknown
  uncultured Methylosarcina sp.
GDWDFWTDWKDRRLWVTVLPIVGITFPAAVQAVLWYRYRLPFGAMLAVLGLLFGEWVNRYFNFWGWTYFPVNFVFPSQFVPGALVLDVILMLGNSMQLTAVIGGLAYGLLFYPGNWPVIAPLHAPVEYNGMVMTLADLQGYHYVRTGTPEYIRMVEKGTLRTFGKDVAP

SEQ ID NO: 610 - protein, 169 aa, unknown; identical to SEQ ID NO: 601
  uncultured Methylosarcina sp.

SEQ ID NO: 611 - protein, 169 aa, unknown; identical to SEQ ID NO: 601
  uncultured Methylosarcina sp.

SEQ ID NO: 612 - protein, 169 aa, unknown; identical to SEQ ID NO: 601
  uncultured Methylosarcina sp.

SEQ ID NO: 613 - protein, 169 aa, unknown; identical to SEQ ID NO: 601
  uncultured Methylosarcina sp.

SEQ ID NO: 614 - protein, 169 aa, unknown; identical to SEQ ID NO: 601
  uncultured Methylosarcina sp.

SEQ ID NO: 615 - protein, 169 aa, unknown; identical to SEQ ID NO: 601
  uncultured Methylosarcina sp.

SEQ ID NO: 616 - protein, 169 aa, unknown; identical to SEQ ID NO: 601
  uncultured Methylosarcina sp.

SEQ ID NO: 617 - protein, 169 aa, unknown
  uncultured Methylosarcina sp.
GDWDFWTDWKDRRLWVTVLPIVGITFPAAVQAVLWYRYRLPFGACLAVLGLLFGEWVNRYFNFWGWTYFPVNFVFPSQFVPGALVLDVILMLGNSMQLTAVIGGLAYGLLFYPGNWPVIAPLHVPVEYNGMVMTLADLQGYHYVRTGTPEYIRMVEKGTLRTFGKDVAP

SEQ ID NO: 618 - protein, 169 aa, unknown; identical to SEQ ID NO: 601
  uncultured Methylosarcina sp.

SEQ ID NO: 619 - protein, 169 aa, unknown
  uncultured Methylosarcina sp.
GDWDFWSDWKDRRLWVTVLPIMGITFPAAVQAVLWYRYKLPFGAVLSVLGLLFGEWVNRYFNFWGWTYFPVNFVFPSQFVPGAIVLDVILMLSNSMQLTAVIGGLAYGLLFYPGNWPVIAPLHVPVEYNGMVMTLADLQGYHYVRTGTPEYIRMVEKGTLRTFGKDVAP

SEQ ID NO: 620 - protein, 169 aa, unknown; identical to SEQ ID NO: 601
  uncultured Methylosarcina sp.

SEQ ID NO: 621 - protein, 169 aa, unknown
  uncultured Methylosarcina sp.
GDWDFWTDWKDRRLWVTVLPIVGITFPAAVQAVLWWRYRLPFGAVLSVLGLLFGEWVNRYFNFWGWTYFPVNFVFPSNFMPGAIVLDVILMLSNSMQLTAVIGGLGYGLLFYPGNWPVIAPLHVPVEYNGMVMTLADLQGYHYVRTGTPEYIRMVEKGTLRTFGKDVAP

SEQ ID NO: 622 - protein, 169 aa, unknown
  uncultured Methylosarcina sp.
GDWDFWTDWKDRRLWVTVLPIVGITFPAAVQAVLWWRYRLPFGAVLSVLGLLFGEWVNRYFNFWGWTYFPVNFVFPSNFMPGAIVLDVILMLSNSMQLTAVIGGLGYGLLFYPGNWPVIAPLRVPVEYNGMVMTLADLQGYHYVRTGTPEYIRMVEKGTLRTFGKDVAP

SEQ ID NO: 623 - protein, 169 aa, unknown
  uncultured Methylosarcina sp.
GDWDFWTDWKDRRLWVTVLPIVGITFPAAVQAVLWWRYRLPFGAVISVLGLLFGEWVNRYFNFWGWTYFPVNFVFPSNFMPGAIVLDVVLMLSNSMQLTAVVGGLAYGLLFYPGNWPVIAPLHVPVEYNGMVMTLADLQGYHYVRTGTPEYIRMVEKGTLRTFGKDVAP

SEQ ID NO: 624 - protein, 169 aa, unknown
  uncultured Methylosarcina sp.
GDWDFWTDWKDRRLWVTVLPIVGITFPAAVQSVLWWRYRLPFGAVLSVLGLLFGEWVNRYFNFWGWTYFPVNFVLPSNFMPGAIVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 625 - protein, 169 aa, unknown
  uncultured Methylosarcina sp.
GDWDFWTDWKDRRLWVTVLPIVGITFPAAVQAVLWWRYRLPFGAVISVLGLLFGEWVNRYFNFWGWTYFPVNFVFPSNFMPGAIVLDVILMLSNSMQLTAVIGGLAYGLLFYPGNWPVIAPLHVPVEYNGMVMTLADLQGYHYVRTGTPEYIRMVEKGTLRTFGKDVAP

SEQ ID NO: 626 - protein, 169 aa, unknown
  uncultured Methylosarcina sp.
GDWDFWTDWKDRRLWVTVLPIVGITFPAAVQAVLWYRYRLPFGAMLAVLGLLFGEWVNRYFNFWGWTYFPVNFVFPSQFVPGALVLDVILMLSNSMQLTAVLGGLAYGLLFYPGNWPVIAPLHVPVEYNGMVMTLADLQGYHYVRTGTPEYIRMVEKGTLRTFGKDVAP

SEQ ID NO: 627 - protein, 164 aa, unknown
  uncultured putative methanotroph pmoA-RC1
  VARIANT (1)...(164): Xaa = Any Amino Acid
DWKDRRLWVTVTPIVLVTFPAAAQVLLWERFRQPWGATVCVLALLXGEWINRYFNFWGWTYFPVNFVFPAILXPGAILLDTFLMLSGSYLFTAIVGGMAWGLIFYPGNWPIIAPXHVPVEYNGMLMSIADIQGYNYVRTGTPEYIRMVEKGTLRTFGKDVAXVS

SEQ ID NO: 628 - protein, 158 aa, unknown
  cultured putative methanotroph pmoA-RC2
  VARIANT (1)...(158): Xaa = Any Amino Acid
DWKDRRLWVTVTPIVLVTFPAAVQYFLWERXRQPWGATVCVLALLFGEWINRYFNFWGWTYFPVNFVFPAILIPGAILLDTVLMLSGSYLFTAIIGGMAWGLIFYPGNWPXIAPIHVPVEYNGMLMSIADIQGYNYVRTGTPEYIRMVEKGTLRTFGK

SEQ ID NO: 629 - protein, 157 aa, unknown
  uncultured putative methanotroph pmoA-RC4
WKDRRLWVTVTPIVLVTFPAAVQYWLWERMRQPWGATVCVLALLFGEWINRYFNFWGWTYFPVNFVFPAILVPGAILLDTILMLSGSYLFAAIVGGMAWGLIFYPGNWPMIAPLHVPVEYNGMLMSIADIQGYNYVRTGTPEYIRMVEKGTLRTFGK

SEQ ID NO: 630 - protein, 95 aa, unknown
  uncultured type I methanotroph
YFPVNFVFPAILVPGAILLDTFLMLSGSYLFTAIVGGMGWGLIFYPGNWPIIAPLHVPVEYNGMLMSIADIQGYNYVRTGTPEYIRMVEKGTLRT

SEQ ID NO: 631 - protein, 95 aa, unknown
  uncultured type I methanotroph
YFPVNFVFPAILVPGAILLDTFLMLSGSYLFTAIVGGMGWGLIFYPSNWPIIAPLHVPVEYNGMLMSIADIQGYNYVRTGTPEYIRMVEKGTLRT

SEQ ID NO: 632 - protein, 169 aa, unknown
  uncultured type I methanotroph
GDWDFWSDWKDRRLWVTVLPIMAITFPAAVQAVLWWRYRIAFGATLCVLGLIFGEWVNRYFNFWGWTYFPINFVFPSQLIPGAIVLDVVLLISGSMQLTAVVGGLGFGLLFYPSNWPMIAPLHLPVEYNGMMMTLADLSGYHYVRTGMPEYIRMVEKGTLRTFGKDVAP

SEQ ID NO: 633 - protein, 169 aa, unknown
  uncultured type I methanotroph
GDWDFWSDWKDRRLWVTVLPIMAITFPAAVQAVLWWRYRIAFGATLCVLGLLFGEWVNRYFNFWGWTYFPINFVFPSQLIPGAIVSDVVLLVSGSMQLTAVVGGLGFGLLFYPGNWPMMAPLHLPVEYNGMMMTLADLSGYHYVRTGMPEYIRMVEKGTLRTFGKDVAP

SEQ ID NO: 634 - protein, 169 aa, unknown
  uncultured type I methanotroph
GDWDFWTDWKDRRPWVTVLPIVGITSPAAVQAVLWWRYRLPFGAVISVLGLLFGEWVNRYFNFWGWTYFPVNFVFPSNFMPGAIVLDVVLMLSNSMQLTAVVGGLGYGLLFYPGNWPVIAPLHVPVEYNGMVMTLADLQGYHYVRTGTPEYIRMVEKGTLRTFGKDVAP

SEQ ID NO: 635 - protein, 169 aa, unknown
  uncultured type I methanotroph
  VARIANT (1)...(169): Xaa = Any Amino Acid
GDWDFWSDWKDRRLWVTVAPIVSITFPAAVQSVLWWRYRLPFGAVVCILGLLLGEWINRYLNFWGWTYFPVNFCFPSNLMPGAIVLDVILMLSGSMTVTAVLGGLAWGLLFYPGNWPIIAPLRVPVEYNGMMMTLXDLQGYHYVRTGTPGYIRMVEKGTLRTFGKDVAP

SEQ ID NO: 636 - protein, 169 aa, unknown
  uncultured type I methanotroph
GDWDFWSDWKDRRLWVTVLPIMAITFPAAVQAVLWWRYRIAFGATLCVLGLISGEWVNRYFNFWGWTYFPINFVFPSQLIPGAIVLDVVLLISGSMQLTAVVGGLGFGLLFYPSNWPMIAPLHLPVEYNGMMMTLADLSGYHYVRTGMPEYIRMVEKGTLRTFGKDVAP

SEQ ID NO: 637 - protein, 169 aa, unknown
  uncultured type I methanotroph
GDWDFWTDWKDRRLWVTVVPIVAITFPAAVQACLWWRYRLPFGAVVCVLGLLLGEWVNRYLNFWGWTYFPVNFCFPSNLMPGAIVLDVVLMLSGSMTVTAVIGGMAWGLLFYPGNWPIIAPLHVPVEYNGMMMTLADLQGYHYVRTGTPEYIRMVEKGTLRAFGKDVAP

SEQ ID NO: 638 - protein, 169 aa, unknown
  uncultured type I methanotroph
GDWDFWSDWKDRRLWVTVLPIMAITFPAAVQAVLWWRYRIAFGATLCVLGLLFGEWVNRYFNFWGWTYFPINFVFPSQLIPGAIVLDVVLLVSNSMQLTAVVGGLGFGLLFYPGNWPMMAPLHLPVEYNGMMMTLADLSGYHYVRTGMPEYIRMVEKGTLRTFGKDVAP

SEQ ID NO: 639 - protein, 169 aa, unknown
  uncultured type I methanotroph
  VARIANT (1)...(169): Xaa = Any Amino Acid
GDWDFWADWKDRRLWVTVTPIVLVTFPAAVQAWLWENFRQPWGATVCVLGLLLGEWVNRYFNFWGWTYFPVNFVFPSILTPGAILLDVVLALSGSYLFTAIIGAMGWGLIFYPGNWPVIAPLHVPVEYNGMLTSIADIQGYNYVRTGTPXYIRMVXKGTLXTFGXDVAP

SEQ ID NO: 640 - protein, 169 aa, unknown
  uncultured type I methanotroph
GDWDFWTDWKDRRLWVTVLPIVGITFPAAVQAVLWWRYRLPFGAVISVLGLLFGEWINRYFNFWGWTYFPVNFVFPSNFMPGAIVLDVVLMLSNSMQLTAVVGGLAYGLLSYPGNWPVIAPLHVPVEYNGMVMTLADLQGYHYVRTGTPEYIRMVEKGTLRTFGKDVAP

SEQ ID NO: 641 - protein, 169 aa, unknown
  uncultured type I methanotroph
GDWDFWADWKDRRLWVTVTPIVLITFPAAVQVWLWENFRSPWGATVCVLTLLLGEWINRYFNFWMWTYFPVNFVQPSILTPGAILLDVVLATSGSYLFTAIIGGMAWGLIFYPGNWPVIAPLHVPVEYNGMLMSVADIMGYNYVRTGTPEYIRMVEKGTLRTFGKDVAP

SEQ ID NO: 642 - protein, 165 aa, unknown
  uncultured type I methanotroph
  VARIANT (1)...(165): Xaa = Any Amino Acid
TDWKDRRLWVTVAPIVXMTFPAAVQACLWWRYRLPIGATVSVVALMVGEWINRYMNFWGWTYFPXNICFPSNLXPGAIVLDVILMLGNSMTLTAVLGGLAYGLLFYPGNWPVIAPLHVPVEYNGMMMTLADLQGYHYVRTGTPEYIRMVEKGTLRTFGKDVAPVS

SEQ ID NO: 643 - protein, 169 aa, unknown
  uncultured type I methanotroph
GDWDFWTDWKDRRLWVTVVPIVAITFPAAVQACLWWRYRLPFGAVVCVLGLLLGEWVNRYLNFWGWTYFPVNFCFPSNLMPGAIVLDVVLMLSGSMTVTAVIGGMAWGLLFYPGNWPIIAPLHVPVEYNGMMMTLADLQGYHYVRTGTPEYIRMVEKGTLRTFGKDVAP

SEQ ID NO: 644 - protein, 176 aa, unknown; identical to SEQ ID NO: 197
  thermophilic methanotroph HB

SEQ ID NO: 645 - protein, 71 aa, Methylothermus subterraneus; identical to SEQ ID NO: 173

SEQ ID NO: 646 - protein, 247 aa, Methylothermus subterraneus; identical to SEQ ID NO: 174

SEQ ID NO: 647 - protein, 46 aa, Methylothermus subterraneus; identical to SEQ ID NO: 175

SEQ ID NO: 648 - protein, 140 aa, Methylothermus thermalis
LWVTVYPIVMITFPAAVQAVLWERLRLPWGATVCVLGILFGEWVNRYFNFWMWTYFPINFVFPTAAVHMAIFLDVVLMLSGSFLFTAVIGGLGWGLLMYPGNWPIIAPLHVPVEYNGMLMSIADIQGYHYVRTGTPEYIR

SEQ ID NO: 649 - protein, 276 aa, Nitrosomonas europaea
MSIFRTEEILKAAKMPPEAVHMSRLIDAVYFPILIILLVGTYHMHFMLLAGDWDFWMDWKDRQWWPVVTPIVGITYCSAIMYYLWVNYRQPFGATLCVVCLLIGEWLTRYWGFYWWSHYPINFVTPGIMLPGALMLDFTLYLTRNWLVTALVGGGFFGLLFYPGNWPIFGPTHLPIVVEGTLLSMADYMGHLYVRTGTPEYVRHIEQGSLRTFGGHTTVIAAFFSAFVSMLMFTVWWYLGKVYCTAFFYVKGKRGRIVHRNDVTAFGEEGFPEGIK

SEQ ID NO: 650 - protein, 130 aa, Nitrosomonas europaea
NENAKITGKFHLAEDWPRAAAQPDFSFFNVGSPSPVFVRLSTKINGHPWFISGPLQIGRDYEFEVNLRARIPGRHHMHAMLNVKDAGPIAGPGAWMNITGSWDDFTNPLKLLTGETIDSETFNLSNGIFW

SEQ ID NO: 651 - protein, 274 aa, Nitrosomonas europaea
MATSILKDKTAQQVTDKPAYDKSEWFDAKYYKYGLLPILGIAVFWVWYQRTFAYSHGMDSMEPDFDRIWMGLWRVQMVVIALAAFSIWGWLLKTRNTAEQLASLTPKQEIKRYFYFMMWLGVYIFAVYWGSSFFTEQDASWHQVIIRDTSFTPSHIPLFYGSFPVYIIMGIAMIIYAKTRLPLYNKGWSFPLIMVVAGPLMSLPNVGLNEWGHAFWFMEELFSAPLHWGFVILAWAALFQGGLAIQLITRYSNLVDVEWNKQDRAILDDVVTTP

SEQ ID NO: 652 - protein, 337 aa, Halomonas  KM-1
MVLRTVSTLSIGALGGAIATLVSLPMAWMLGPLFAVLIASLAGVRAGIDKRLHRGSIAMLGLFIGNRIELGELSHLLEWYPSVLAMLVYMGLMLAGGAWLFSTSGMSRLSAVFCSFPGSMNATVILAERLGVDIRWIAITHAMRLVIVVASAAFMASYLAGGIALGEGNGVSWAGVSLLLLAPASWWLGRLLRFPLPEFLGPMAVGVVLATLGHGVALPDVLLVATFLVLGSSVGARFAGTPWQRVVQVGRYGLLFGLYAVLMAVATAWLLASFTAHSFTAALLALLPGGVGEMAVIAVALDVDPLYVVSHHVLRLLLLILATPAIISLSRRLANKA

SEQ ID NO: 653 - protein, 356 aa, Halomonas elongata
MLSGTLANGWKATRRLLPTLLLGLVGGALAYGAGLPLPWLLGAMLVTTAASLTGVRLRSPGGSRQVVLVIIGVMLGTAFSPGMSGDLLHWGASLIIMLLATAVMMAISVSFSRRVAGYSADTALYAGVPGGVSAVTLMAMNSRADLRIVGMTHAVRILILLLAIPPILQGIGHVSLQPGTRDLAQWLWLPSLGETGWLIAAGVGGSWLGRRLRLPNALLFGPALVSAALHITGMSQAAIPPTVMALAQVVIGVSVGVRFAGTSLREMGRNLLMAALQAVMLLLVAVLAAWGAHELTGYSPAAALLAYMPGGAPELSLVALSLNIDPAFVTSHHLLRISVLILAMPVLLNYYKKRSA

SEQ ID NO: 654 - protein, 345 aa, Pseudomonas extremaustralis
MSEITFRQWWGTPLVGLAGGYLASLVGWPLPYMVGALLAIILVRCLTPWQLAEIPGGRKCGQWVVGIGIGLHFTPVVIEQVMSHFGLIFIGALVTSLSSVVGVWLMRRSGEDRATAFFSSMPGGSGEMVNLGARNGAVLSRVAAGQSLRVLMVVLCVPAIFKYLLEGGAPQFHPAPVSWAWLAVLFPLGALVAWGWQRLRQPNPWLFGPLLVSATASVVWDLHIGLPDGGSQIGQWLIGSGLGCHFNREFFRRAPSFMGRTLIGTALTMALATLAAVGLSALTHLDLRSLTLGMMPGGIAEMSLTAETLQLSVPLVTAMQVMRLLFVLFLAEPLFRHWNHQPEKI

SEQ ID NO: 655 - protein, 342 aa, Methylococcus capsulatus
MKAWVIDRIGPLDSSRTLLRATDLPVPEPGPGEILLQVAVCGVCHTEIDEIEGRTAPPRLPVVPGHQAVGRIAALGSGVAEFALGDRVGVAWIFSACGECEFCRSGRENLCFAFCATGRDVDGGYAQYMTVPAAFAFRIPEGFTDAEAAPLLCAGAIGYRSLNLSGLKNGQPLGLTGFGASAHLVLMMARYRFPDSEVYVFARHPEERAFALQLGAVWAGDTADIAPAPLAAIIDTTPAWKPVVAALANLAPGGRLVVNAIRKAPDDRACLAELDYARHLWMEREIKSVANVARSDVAGFLALAAEMGIRPETEEYPFEDADRALLDLKQRRIRGAKVLRVT

SEQ ID NO: 656 - protein, 355 aa, Methylococcus capsulatus
MPTAKAYAAFSADSALAPFVLQRRDPLPQDIRIGILYCGVCHSDLHQARNEWNATTYPCVPGHEIVGKVLEVGRSVTKFKPGDTVAVGCMVDSCRTCPNCVDALEQHCEHGPVFTYNSPDPHGGGMTFGGYAESIVVDEAFVLRIPDGLDLAAAAPLLCAGITTYSPLRHWKVGAGQRVGVVGLGGLGHMALKFAHTFGAETVLFTTTPDKAEDARRLGADEVVVSRDPEAMARQAGRFDFILDTVSAPHDIDAYLNLLRRDGTLTLVGVPPQGVQVMPFSLIGGRRRLAGSLIGGIRETQEMLDFCGEHGIVCDIELIPIQGINDAFERMLKSDVKYRFVIDMATLNGESSGGR

SEQ ID NO: 657 - protein, 332 aa, Methylococcus capsulatus
MKAIVMTRPGEAAEVLELRDLPEPALTAPTQIKVRLRAAGVNPIDTKVRRRGLFYDDALPAVLGCDGAGEVVEAGAEVDRFRIGDRVWFCNGGLGAEQGNYAEYTVLDQRWAAPMPASSAFASAAAGPLVLITAWGALYDRGRLQPGQTVLVHAAAGGVGHVAVQLAKLRGARVIATVGSEDKAALARGWGADETIDYRTQDFVAEVNALTGGRGADLVLDTVGPEVFRRSVECTAHFGDLVTLLDTGATSLAEARMRNLRIGFELMLVPMLRKLDAARDHHVEILRACGEWIDDGKLELYVSGVHPLEEAARVHDIIEAGHTTGKRVLCID

SEQ ID NO: 658 - protein, 345 aa, Methylomicrobium alcaliphilum
MTIEAKAVFHTAAREVALKTVKLPTLGDDQVLIKAHHSAISPGTEGMIFDGRFPQELAQDATIPSLAGSFAYPFRYGYALVGEVVEVGARVDKSWLARKVFTFHPHQSHAAVALSECLPIPDGLSPLDALFLPNMESAVNFVMDAAPLLGERVLIFGQGVVGLLTCELLARFPLASLITADPVASRRELSKRVGAAQCIDPNDENAWRDLEDCLREGGADGFDLVIELSGNSEALNRAIDMTGFSGRILVGSWYGNKRVDVDLGGHFHRRRIQLLSSQVSTMNPMLSGRWDKHRRIATAWHWLDAIEPARWITHRFRLEQCKQAFDTNAGQKDAALQIIFDYQDD

SEQ ID NO: 659 - protein, 326 aa, Methylomicrobium alcaliphilum
MPQDMQAIEIVAPGKLGTTHRPLPMPLADEVLIRVEAAGVNRPDIMQRQGLYPPPPGASDIPGLEVAGTIAVLGGDVRHLQLGDRVCALVTGGGYAQYCTAAAELCLPIPKGITVIQAAGLPETFFTVWSNLFDRAGLKPGETLLVHGGSSGIGVTAIQMAKAFGVRVFVTAGSARKSAFCLELGADAAINYREQDFVEEVSALTSGRGVDVILDMIGGDYFPRNLKCMAFDARLVQIAVQGGPKAEINLLQVFLKRLTITGSTLRARDNAFKSAIAGKLREHVWPLLESGDIHPVIDTVLPLAEAAEAHALMESSQHIGKIILTV

SEQ ID NO: 660 - protein, 397 aa, Methylomicrobium alcaliphilum
MQFKPFSISRLPRISYGRGRLSEVPALTASYGGNALLVTGKQSFCGTERWPSFIESLEMQGVRWLHVTVSGEPSPELVDLTVSRFCDETIAVVVGIGGGSVLDAAKAIAGLLPHGNSVMDHLEGVGRNIPYRGPSIPFIAVPTTAGTGSEATKNSVLSVQGPEGFKKSFRDECLIPEYAVIDPDLLESCPRDLIAADGMDAFTQLLESYVSLKANPFIDALAWSGMTAFKEGFFAAWEGQEPEAANGRAAMAYASLLSGITLAQVGLGSVHGLASPLGAFFPIPHGVVCGTMVAAATEINIEAMQAREPDNPALAKYAQVGRLLTGRNDIGDSVVRDLLIALLAEWSKTLQLPRLRDYGIREADFAKIVANSRGSSMKTNPIVLTDTEIEAILQRRL

SEQ ID NO: 661 - protein, 340 aa, Methylomicrobium alcaliphilum
MNYRQEKNQMKAVLMTGAGGPEMLQLADIAEPNIVKPTELKVRLKAAGINPIDTKVRSNGLFYPDALPAVLGCDGAGVVDEVGADVLNFKPGDEVWFCNGGLGREPGNYAEFTVLDSRWVAPKPKSLSFVEAAALPLVLITAWGALFDRGGLQDGQTVLVHAGAGGVGHVAIQLAKLKGAEVITTVSSESKADFVLSLGADQAIDYRQCNFAERVNELTGGRGAEVVLDTVGPEVFKDSIEATAHFGSLVTLLDPGALNWSEARMRNLKIGFELMLTPMLRNLDSARDKHVGILNRCAEFIESGNLRGVVGHCLSLDQAAEAHRLIGEGHTQGKIVLEII

SEQ ID NO: 662 - protein, 351 aa, Methylosinus trichosporium
MSTKAYAVASAEALFGPLAIERRALGPEDVEIDILYCGVCHSDLHTARSEWPGTRYPCVPGHEIVGRVTAVGAKVTKFSVGDLAAVGCMVDSCRRCLSCDDGLEQYCEHGFTATYNGPIYGSGENTFGGYSEKIVVDAHFVLAIHHSETQLAGVAPLLCAGITTWSPLKHWGVGPGKSVGIVGIGGLGHMGVKLAHALGAHVVAFTTSPSKRDAALALGADEVVVSTDPAAMAARAGSLDFILDTVAVAHDLDAYVNLLKRDGALVLVGVPATPHPSPSAGGLIFKRRQVAGSLIGGVKETQEMLDFCAERGIVADIETIAMQQIETAYARMLKNDVKYRFVIDMATLKAA

SEQ ID NO: 663 - protein, 328 aa, Methylosinus trichosporium
MSAFRAIRIDKDEAGYRAAYAELGEADLMEGDVDVAVTHSTINYKDGLAVTGKAPVVRRFPMIPGVDFAGRVTRSAHPDFRIGDTVIAGGCGLGEVHLGGLAERARVSGHWLVPLPEGLTAAQAMAIGSAGYTSMLCVLALERHGLEPAKGPVVVTGAAGGVGSVAVALLAGLGWHVVASTGRPEENAYLKSLGAAEIIDRAELSAPGKPLQKQQFAAGVDTVGSVTLANVLARTMWDGAVAACGNAQGMELPATVAPFILRGVSLIGVESVRPCIPLRRRAWERLARDLDKGTLAAMTETAPFDAALERARSIVSGKIRGRLVIEIG

SEQ ID NO: 664 - protein, 329 aa, Methylosinus trichosporium
MTRIVRFHRLGGPDALQIDELDIGAPKAGEIRIRVRAIGLNRAEAMFRSGGYIEAPRLPSLLGYEASGEIEAIGEGVTGFAIGDAVSTMPAFSMTEYGVYGEAAIVPAHAVVRHPSFLSWSEAAAIWMQYLTAYGALVEIGGVGKGDAVVITAASSSVGLAAIQIANAAGATSIAVTRTRAKREALEAAGAQHVIVTESDDLVAETLRITRGDGARLVFDPIGGPGVDALAEAAASGGIIFLYGALASAPTPFPLFTAIRKQLSLRGYTLFSVTRDPSKRERGVRFVLDGLAKGSLRPIIARSFAFERIVEAHRFLESNEQVGKIVVTV

SEQ ID NO: 665 - protein, 699 aa, Methylosinus trichosporium
MKQIRQNYRSGELALAEVPAPRAGAGALLVATRVSLISSGTERQTIELAKASLAGKAMARPDLVRRVIRNIRRDGLAPTVEKVFAKLDTPIPLGYSIAGEALEIGRHVENFRVGDRVACAGAGFANHAEIDAIPKNLVVRVPDGVDDEEASFVTLGAIALQGVRQAQPTLGECFVVMGLGLIGLLTVQLLKANGCRVLGYDPDASRVALARELGADLAVGEGLLEATKAFTRGHGADGVILAASTKSSEPLNIAAEISRMKGRIVVVGLVGMTIDREPFYKRELDLRLSMSYGPGRHDPGYEFEGHDYPLAHVRWTEQRNMEAFLALVAERKVTPKALVTHRFPIAEALAAYALMQSGAPHLAITLHYPREAPEPTRMVRSAPAPQRRDGEATLGFIGFGNYAKSVLLPAFSAIDGVRLAAVATSTGLSAGHAAEKHGFAAATTDADALIDDAEIDALVIATRHDTHADYARRALIAGKHVFVEKPLALTREELRDVAVAAEAAPGVLTVGFNRRFAPLLIEAKRALEPRSGPLVMLYRVNAGEIPAESWIQRGEGGGRIIGEVCHFVDALTYLCGALPIEAQATAARDHDDAVSALLRFADGSTGAIVYSSLGDPAVPKERIEIFAAGRVVQLDDFTRLDITRGGRRRRVKAAQDKGQRALARAFIEATRGRGAPPIPLAELIAVSEATLAIEEAVRE

We claim:

1. A non-naturally occurring bacterium, comprising:
a host methanotrophic bacterium having an exogenous nucleic acid encoding an enzyme with methane monooxygenase (MMO) activity,
wherein the MMO comprises an amino acid sequence having at least 90% identity to the amino acid sequence of any one of SEQ ID NOS: 99-102, 174, 197, and 649-653;
wherein at least one alcohol dehydrogenase enzyme is inactivated in the non-naturally occurring bacterium as compared to the host methanotrophic bacterium; and
wherein the non-naturally occurring bacterium is capable of converting methane into methanol.

2. The non-naturally occurring bacterium of claim 1, wherein the methanotrophic bacterium is selected from *Methylococcus capsulatus* Bath, *Methylomonas* sp. 16a, *Methylosinus trichosporium* OB3b, *Methylosinus sporium*, *Methylomonas methanica*, *Methylomonas albus*, *Methylobacter capsulatus*,*Methylobacteriumorganophilum*,*Methylomonas* sp. AJ-3670, or *Methylomicrobium alcaliphilum*.

3. The non-naturally occurring bacterium of claim 1, wherein the bacterium is capable of utilizing $H_2$ as a reducing agent for converting methane into methanol.

4. The non-naturally occurring bacterium of claim 3, wherein the bacterium comprises a nucleic acid encoding a hydrogenase enzyme for utilizing $H_2$ as a reducing agent for converting methane into methanol.

5. The non-naturally occurring bacterium of claim 1, wherein the enzyme with methane monooxygenase activity comprises the amino acid sequence of SEQ ID NO: 174 or 197.

6. The non-naturally occurring bacterium of claim 1, wherein the at least one alcohol dehydrogenase is inactivated by genetic modification.

7. The non-naturally occurring bacterium of claim 1, wherein the at least one inactivated alcohol dehydrogenase includes methanol dehydrogenase.

8. The non-naturally occurring bacterium of claim 1, wherein the at least one alcohol dehydrogenase comprises an amino acid sequence having at least 70% identity to any one of SEQ ID NOS: 655, 656, 657, 658, 659, 660, 661, 662, 663, 664, and 665.

9. The non-naturally occurring bacterium of claim 1, wherein the non-naturally occurring bacterium is capable of converting ethane into ethanol, propane into propanol, butane into butanol, ethylene into ethylene oxide, propylene into propylene oxide, butene into butene oxide, a mixed alkene substrate into a mixed epoxide product, or a mixed alkane gas substrate into a mixed alcohol product.

10. The non-naturally occurring bacterium of claim 9, wherein the non-naturally bacterium is capable of converting a mixed alkane gas substrate into a mixed alcohol product and the mixed alkane gas substrate is wet natural gas or a partially separated derivative thereof.

11. A method for converting methane into methanol, ethane into ethanol, propane into propanol, or butane into butanol, the method comprising:
exposing the non-naturally occurring bacterium of claim 1 or a cell-free fraction comprising the MMO and derived from the non-naturally occurring bacterium of claim 1 to: (a) $O_2$; (b) a gas substrate comprising methane, ethane, propane, or butane, respectively; and (c) a reducing agent;
wherein the methane gas is converted to methanol, the ethane gas is converted to ethanol, the propane gas is converted to propanol, and the butane gas is converted to butanol, respectively.

12. The method of claim 11, wherein the non-naturally occurring bacterium or cell-free fraction comprising the MMO and derived from the non-naturally occurring bacterium is immobilized on a solid matrix in a substantially non-aqueous state.

13. The method of claim 11, wherein the reducing agent is $H_2$ gas or formate.

14. The method of claim 13, wherein $H_2$ gas is mixed with the gas substrate or provided to the non-naturally occurring bacterium following the gas substrate.

15. The method of claim 11, wherein $O_2$ is mixed with the gas substrate or provided to the non-naturally occurring bacterium prior to the gas substrate.

16. A method for converting ethylene into ethylene oxide, propylene into propylene oxide, or butene into butene oxide, the method comprising:
exposing the non-naturally occurring bacterium of claim 1 or a cell-free fraction comprising the MMO and derived from the non-naturally occurring bacterium of claim 1 to: (a) $O_2$; (b) a gas substrate comprising ethylene, propylene, or butene, respectively; and (c) a reducing agent;
wherein the ethylene gas is converted to ethylene oxide, the propylene gas is converted to propylene oxide, and the butene gas is converted to butene oxide, respectively.

* * * * *